United States Patent 10,174,376 (METHODS AND COMPOSITIONS FOR DIAGNOSING, PROGNOSING, AND TREATING ENDOMETRIOSIS) - sequence listing, part 5

SEQ ID NO: 106 - DNA, 190778 bp, Homo sapiens
cctcctccacagtggtgaggtcacagccccttggagccctccctcttcccacccctcccgctcccgggtctcctttggcctggggtaacccgaggtgcagagctgagaatgaggcgatttcggaggatggagaaatagccccgagtcccgtggaaaatgaggccggcggacttgctgcagctggtgctgctgctcgacctgcccagggacctgggcggaatggggtgttcgtctccaccctgcgagtgccatcaggaggaggacttcagagtcacctgcaaggatattcaacgcatccccagcttaccgcccagtacgcagactctgtgagtacccgggagagatcagggtaggacccagagatcaagggcatctgcagaggtggcccgaagtgcacaaaagcagctcaataacagcccgaagtagtgtgtgagtgtgtgtatgtgtgagtgaatgtctgtgtgtgtagatgtgtgtgtgtgctaaaaacttaatcgcccacacttgggaaggtatcattgttgacatcctcattcccaacacaggaaaatgttacaaaactttggtgtacaatgaccgtgagagctgttctttccaacaagctgctattcagcactttgcctaaccctggttgaatctgttttatttgaattaataaggataatggcatctcaggaactgacctttttgatcttaccttgggtaataaaaaattgcaaaaatatgtatttctcctttttgtttctctagatgggaggttatcttagcagttctgctgattcatcaaattgttgacaaaggtttaagcaggggccctttttaaaatgaactgtctatacagtatctgtaagttacttactcaaatgtgaactgccagtgaaatagtacgtccagaaccctgctttgtgatagaggtataaagaaatgaaatttcataaaagtatagtacatttatctgcatgttaaatgttaccagattagaaacctgatgttaaataagattatacacacacaacctgtttcttaacagcaatttaaatcagtgatcattgaaattgtagacaaaaccaagggaataaagtctgtcttgattagttaaaaagagaacagaaagaaaggacagtaaaacaacctaggctggttaaatccagttaagataaaaaaaaatgcaggttattaaagaaaatgttgatagatgaaaagaaatgggaaagttgcacctctagattttctcaagaatttagctcatgaagactatttaacagtagatgaatatttgagcacagagatatatttctgtgctcagagatatcctagtgtcttagcacacctgaattaattagttcaataacctccaaacagtgtggtagtcattctccatgctgccaccacagaataagatgtgtaaaaggtgtaatggcctcttgattacacctctacataggttgcttgtcacctctagaataaaattcttttgtgcagcctaccagatctttcaagacctagtcaagtctttccaacctcattgctcctcatttctctaacttccccctcctgctgagaacttctggcacttccccaaaggtccctgctgttacagctgcccttgcctttcttcccactttctggcccctctgcctgaagcacatttcacccatttcttcacccagctaatgcctactcccagatccagatcctggatcaaccctgcaggaagcttctcctgacccatgaccttcaggctgggtaagctataccccccttcccaacagcgttctctgcatgaacctaaccctagcccttagacattgtctactttcttgtaacttgttatttatttgcatgcccactcaagcaggacacaagcttctctaacatagggaactgccattcaaccccgaattcctgaaaccctggaactacttagacactcagaaaaaacaaaaaaaaaaaaacttaagtgaataaataaacaaatgaatatgccaggtctctgaatgtccactctatgttggggagaaagaaatccaaagacatcacttcttcagagacttctttaacagtggcagaaattcaagtcattgaagagagatgtggctctgacagtgaaaaggaactcgtagacatcctgtttaaaattccaccaaaagttgagaaagaaagggtaatggagaatgagcaatggaacaggagtcaggaaaccagcattctctttagcccttctttactaaccatgaaattgtgtaagatgactgatttggaaggagccaaatttccttctgggtaaaagagaatgttcaactaggtgctttctaggtgatgacatgatgctgatgagaatagtctgagggaaggcactgaatcacaagaaaaagacataaagacagtggcaaggaggatctgcccttgagaataatggagagggaggtagtatgtcctgaagaataaagttattctgagatcgaaaagagaaacctgataaaaagtgtgggtaaaacaaaatggtagtctcctttgaacaatggctactaccatctgcaacagtagaaaaatgatttttaaatcttttgggggcggtagaactctttgttgaagaaaagcatatgagagaagtaaaacatgtaaagctaacaattatattgtgtttacttacgggggcggggggtcctgttctcagcgctttgcatgaactcacccagtgaatcctcaccaaatccaattaagtaggtgatgttattatgctcattttatagatgaggaccttgaggcacaaaaataaaatgaagtaatttgctcaatgttgcacagcttgtaagtggtaaagtcaggatttgaatatcatatcatcaactatggagcctgcacccttaagccaccactctcagatgagaagtgtgtctcaccacaccagtgttcccctgatggtcataggctttggagaaaaaagtctgaaaacaagtcacattcagtaaaccgactgataacctcgggggctattcatcagatgcaagaactcagaaagcaggaggttagcagggaaaggaaagaagaaggaaggaagaaagagagagtggaagagaggcaaggaggacaagaaagactaagttagtctttcttgacaagaaaatctagatctttttttacatctttctagacaagaaagatctaagttatggaaggtattccttgctgaaataaaccaagtttttgtcattaaaaagccgttctgggtggtgacctctttttggaatctacttaaattatacaggatctactactgaggcatgttctctcacaagttttgtattattcagagtgtacctctttttaaagtttttgaagagcttacactggtttaaaatgtaaggtattttgttcctgtagagttatttgcattacttctgcaaccttcattaagatgctgtataaccacttcttagacattttacaaattatgatggtgccgagaacaactctttctaaactttatcttctactcatagattattgttctgaaaggtaaacagctctcttgccctactacccatatcccagccccgtggtcttatggatgcaggggagagagttacggactgtggccctcactgaagaagtgatgctgtatcttttcctcactcctcccctccagaagggtatgatgctttacctgagtggaaggtgagggagagctgggatccctacttcccccactgccagtggaacattctagaatctttgatgtgtaggtagtttgaaaaaaatcactctcttccattgaaaattactgatttaaggaaacttaaatgaagcaagagaataaaattaaaaatttaaatgttggcatataattatagatcatatatctcaaaaccaaggataacaagattgacccatcaccctctcttactcagaaagttgccatttgttgcctctgtgcatgagaagatccttccttctctgaataaggaggtagaaaggatttgacaaccattctgcaccactctatgtatttgtgtggattcttcctccagaaagtgctggcacgccttactgtgttgttttaaccctgctttcagtttcattatgacagtaactgctacatctgccttctccaaccccactgccatctgtggtcttgggtttcgacgaagtaagtggtttggacacctgtgtgccttcagatatgtttctgaaggagctgttgttttcaggttctgtttttactcatttgcattctgcatctgtggctctaattgatggactctcctactgtttactaaactgaagacaatcattcatcatctttggcatttgtaccctgtgttccatctgtgctgttatttactcagtatttttaagttgactcgcttctctaactgaaatttatttagaaaggttacaagtggaaaattagcatgacttcgtacaaataagaggtaaccagaaaactaaagacagaaaaaacaaaaatataattaaattctagctacagactattgtctgtgaatacactgagcctacagctgccttctctttgttaaaaaggaagcaaagtaagtgttaataagtattaaagagataacaatctggcacggtgtccttggtagtatcgaaaggatggaaagacaatagagaaaggaattactttctcactgtgtgattcacggttatttaatgccaggtgggcactccacctaaaataatctcacgtacctccaagtcatctttgttccacacttaaagaaatgtggatgttttgtatatttcacaatggttttagtcacaatcagtggttgtaatctgaataacaattgtttccaagctaaagagaagccccctgcttcaacacccacgtgctccccaaacacagccccacacatataaaggtgacttcatttcatatatccaggctctgtgaattattcttttccattctctctctcctctcccatacatatgaaacactgttctaagaggagtgaagaattctgacctgaaagttaaagggatttgatttattcacttggaatgaacataataatgaacaataaaatgtgtccatcatatatatatgagagagaatatatagagagagggaatatatctgtatacctatgtgtatatatatttagacagatatatatgtgtgtatttaaatcagtcaaggtttctgatgataagtaacagaaaaccaactctgtttaggttaaggaagaaaaaaaatattttgaaagaacatgtaatttacagaattactgtaggaccaggctttgaaaataggccaaggcctactgtgggcaaggaactggagccacagtgaatcatctgtttaggacaattccatgggcaatatagaaaccacagccactggacatctgcggtcttgtagctgccagactgtctatgtgctgccatcaataatttcccaactgtccctgtctctttaaatatcctacctgggagtagtatcctgtatgggagcatttgattggctggcaagccatagctgctggaggtaggaagagaaaggtggtcacccgcccacttttggcgtctgaaataggagacgcagaactgggtccttctaatattccacacaacaggggattccccactgaagaggggccatatgccctctacattgctcattacttccttcattctgcaaatctttactaaggactaactatatcccagacactgtgtcacactctggacttaatggagaacaccaccaacacgtccctgtctgcagggatcttacagtctagtgtgggagctgcatattaatcaaataattacataaacacagagttataattgtataagtgtgcttgagtatgctctttgtaggggtgagggatatttacttaaactgaggttcagcgaaggctttgagctacctcctgaagaaccagtaggagttgagtgtaagaagtttcagtggagcaggtagaaggtggagatgtggtgttcaagagctttgaagaattctgacctgaaagctgaaggggtttgatttattcacttgggatgaacatattaatggacaataaaatttgttactactcccttcataactcagtacaggttgaggtgaattctgatgtccttgggagcagtttctatgcacacacaaaaaaaacagttaatgggggtagctggcttcgtaaattaatatttggtttgttaaagaaataaatgtaaaacctagttctttattgagttttctatgtatttattattttgtttggaaatctaatcgtaacaattactttgaggagtattttatcatttaatattttaataactgatttcccatatagtttaatcaaataataaataatttaaatgaaaacaaatttaatgtattttattttaaagtacttgaatgcttgatgaaaccttcccaatccttagaaaatttgaaaacatctattatattaaactttataagtaccaggaatcctatgtttttagattgccaaactctggagtgagatcctccgggttgaatgccttggtctgctatttcctaaatatgctttgggaacattgcttagttcctctgggcctcagtttctccatctataaaaaaagagtaataataggccctgactcaccagattcctgggtggtatgaatgagttaatactgtcaacagataattttcaaagaaaggaaaaattgtaactttcatacacctataaattgaacacatgttaaagattttaatgaactcattgatgagtgtatatgaattgcctaagattgccataacaaagtaccacaaactgagtggcttaaaacaacagaaatttactctctcacagttctggaagctaaaagttggaaatcaaggtattggcagggtcatgcttcctctgaaggctcttgggacaaatcctttctggctcttcctaggggctggttgctgttggcaatccatggcattccctgcatcactccaattattggttttaggctcaccctcattcactatggactcaacttaactcattacatctacaaacattgtatttccaagtaaagtcacattttgtggttccaggtagatatgaattttgggggcatgctttaacccaccataatgaagaacctggtaagatattacaactggcttaaagggtagcccaccaactagacatatttataaattaggaatatcagagtgactatgcagatggaggccaaactagcttcttccctagtcagggagggaagttcatagaagctcttccatacgggacagaatttacaatccgtagacaaaattgttttgcattgctacaattatctacaatctagaaaggtgtaaaataattcccatagaatcagactgagaaacttggaagggtgtgctctagtcaattcacagcttttcattgaaacacatttttccccagtaatacatgcaaaattatagaaaagttaccacctcccagtgagcactatacaagtaaacttattaaaacctctaatttccttttcaacttaaatcacaagtcaaaataaattactcaattatacattttaaattggaatagcaagaccaatctattagatatcccaagtaggtcaacaacttctgttaatacaaatactcaaaataccaaatatatattgattattcttaaactcaacacaaacatattaatactatgggtctgatttagattctcatttctattgttaactctaaattttcccaagctaaaaaatgtttattaattttaaaaattgatcttcatcccctaatgaactccaggttctttatggaaccatccactggtttccaggttccatatagttagggttgccctatccaaatggaccctcctcttacacctgtaaggcagaaaatatcttttctttacccatcacatggtgcatggctgagaccctacaacaacaacaaaaaacagattgacaagaaaaaaaacattaaacaactattaaatataagttttacatgacacaggaggcttcagtaataaagacccaaaggaacagagaaaactgtatctttttatggacagtcatacagattggaggacaaaaggatatgatcgaatggtaataaactgtggtctgtggggcagatcttagcaagtcttatttgttcaaattcatcttgatgtctttgtgtcttcattccttttctcctggtgtagggagagcccctctgaaatgagggtcttaagacctactttagaggaagaccagagaattgtctgatgacctgactcaggggagaagggcaggaaaaagtcggagagaccttctgcttctgttgttttctcaaatgccaaggtgtcacatttggggatagaatgtcttgaaccccattacatctgtcattcaagtgtagttaatagcattcctttcactctcaaaggtgtcccaatttgggggataaattgctaatactaatagatcttcctattagaccatgaagtccagaggcccgtgggacatgctcagccttgtgtttcattgccgtaggtgggagtctatcacttaaaagaaggttggtctcagccaggtggggtggctcacgcctgtaatctcagcactttgagaggcggagcgggggcggatcacgaggtcaggagatcgagaccatcctggctaacacggtgaaacccagtgtttaaaagtccaacctcaacaatcagatcagttttgatgaggccaagaccattcagacatgatatcagaggcatagatccagaatgtccagttattttcatctgtgtgaacaaattagctatcctggggcctaagtctattctcttagatcacctctgatgaagtagtaagcatagaaaactaattcgtaatacataaaacatattgttaaatgaattagttttgtctgaatttatcagtcaatttactagagtagtagttttttgtccagagctgagaaattaagttgaattgatctatttgattatttcagtgtttcctggttatacaaagtgtgtttgttacccttcagactaaggtttattagacaaaagttcatgggcctccaggagttcatggttgtgctcttaggaatctgtggttgtgtgaaaatttgtccccatcagtgcatttctgagactctataactttccttagatcttcaaaggtgtccttgacccctcacaagttaagaaattctgctttggaataatttggcattttgtaagtgtactcactatgactcaatctttttattatattacaaacaaccctaacagacatattttaacaataaatgaaaatcgcctgacctttgtgtggcaagctgtcacagttagttactacttgagactgtcatttcaacagttactactgttactacttgagaccgtcactaggacagttactactgttactacttgagaccatcattgtgagaatgaacaaaggaatgaacgtagaaatgaaaaagtaagacgaaactgttttaaagaaagtgtccaggggaagaagaagagagctccctgcttctagtgagcaaaggcagcccctgagcttccacagccctttgtatttattgggtagcaagggcagggaggaggaggtaacgattggtcggctgcttaattgatcatgggttcatattgttactaacaggcttcagatgtacctaattacaagcaacactgcgcttggggtgtgactgccctcagcattccttctgggtggaggacgcacttttgtcagtttgccaacattctgcatttatgagaacagtttgctgtttactcatagagcctccagtggtatagtgagttgatcacgaccctcactctttcagcctgcaacacctttgaatgtcatggttttccttctgaacatgttattgtggtgattactttcttcatggctcacacttagcctgtcccttgataggctcttcacacagaagttcactgaatgttgccactttttcaagtcaatagttgacagattttttcaagtttctaatgcctcctacatgatggtaaattcttcatactgactctgtttccatttttactgaagctggtcaacatacttaattactctctttcattacattaattaaaaaatagcatttgaaaattttaagaatgagcaaaatggtcccatttgttcaaaattatagattgagttttaaagtgttccatttagatatcagaccctacttacttggcttcatttctgtatgaacctttaagaacatttagggtattccagaaattttcaaaataattttttaattacaaagttggcacttgtgatttttaagacatcttataaatattgttctcttatatgtggtgacaggtatatgtgctctggatttttatagcacagtcccactgaaaagactgccatcagaatgttccagaaattcaaatatttcatcatccttttaatctaaacttcccacatcacttgcacacctggaaagagcttccttatgtccaaatttttctttcagaaaacatgatctctgtatttatatgacacatgaagcttttggcttatattttgtaggcattaacttaatcttacccatgcctgtgtgttctcataattatgcaactccagcgaggagactgaaattgtttcctcttattgccaggtactgtcactttatattttgttatttcaatctttttttaagccaagaaactagaaggctacttttaggaaagggctctgtgcatgaaaataaagaggatctaaggacgggcataaatgagatactcttccatgagaaagtctttagtgggctttgagatggcagtatttccatctcaacacccttggcagttatttctgggtttgtggacatgatccaaagatttgagatgaccagaaatactacctctagataggtggcattttattgtaaaatgttcttccttctttccttttttatattttaaataaatatgtattgatcacctatcatacactagtactattctaggcattgatatataataaacgacctcattgattttacatcataacaggagaaaatagcaaaaaaaaaaataaaaatttaaaaatttaaaaaagtaaaacagagaatgtcagatggtgaaaagtataatggagaaatataaatgaaggaagagggagaaggaatactggaagttgcattttaaatagtcagcaaggtgtcttagtttgggatcctctaacagaataccacagactgagtggcttacacaataaccatttacttctcacagttctggagactggaagtccaagatgagggtgccggcagatctgttgtcttgtgagggctgcttcctggtttgcacttgaccaccttctcattgtatcttcacatagcaaaaagccaagctcacctctcttgtgttttttattataagggcactaattttgtcataagggttccacactcataaacgaatttcctcccaaaagccccatcttctaatactatcacatcagagattaggatttcagcatatgaatttgggggacacacaaacattcagtccataacagaagccctcactgagaaaatgacatttgaataaggacctgaagaagctaaaaaaggaatccaggctaatatctggaggagaaaaaaaaattatatatatatatgtatgtgtatatatatatatatatatatgcttatttttggaatgagataagaagctattaaggattttgagccacacacacacacaagcaagacctgacttacattttttttttttttttttttgagacagagtctcactctgttgcccaggctacagtgcagtggtgtgatctcgactctctgcaacctgcacctccggattcaagcagttctcctgcctcagcctccctagaagctgggattacaagcatgtgccaccatacctggattatttttgtatttttagtatagatgggttttcaccatgttggtcaggctgatctcgaactcctgacctcaggggatctggccgcctcggcctcccaaaatgctgggattacaagtgtaagccaccccgcccggccctgacctgacttacattttagtaggatcaccctagctactatgtttcttaatcgggtgagagatgatactggcttgaaccagcttaattgcagggaatgtggtaagaaatttcctgggcttattttggaggtgaatccaacaggattttctagcggactatgtggactttgagtaaaagagaggagtcagtgatatcttagtctgaattctccagaaagcagagcccatgtgagaattcttgttggggagtatgatcccaggagcagaaggtaggatggggaagtgaagcagggagagagggagagtttgctgctgctagaaacaaatggttgctgaaacccctgagaccacctgagaattcagatgacttgcatctcaggacccttgctttaggaaggaggaaaggtaaaacatctatccatcagttcttggctcccatgagtcagggatttaattctactgaccttccaggtttcctgtgcctgggtgatgaaagaatttcctgatattaacaaaaaagtccccaggtgggagatgagaggtgtgtggtacagggctgagatgcagtactgtcgagttgtacctgcctgaagctagtcagagctcatacagaactggtagctgcagcagggctagcataagaggcaagctgagagaatctaaaatgatgtaaaacaggtacccagggttggttagcctttgcacaactcagacctgcccaagcttttcattatgtctagctcccataataaaatatagggcctccgattttgtaagaatgagatgtccttactttttttttttttattcttacaagaaaggggaatacaagccccatcttccacagattccttcaagatgcagtccttgcaaagacataatgcaagagggtttgggaaataaactagtctgccctgctgcagctgatcttaaggatgccattgatagtccttatctctctttgactccaatcctagatttgtctcacccttgcccagcactctgactggttgagttgattgcctgatggaaagacccagacttcagctccaagggttctgaaagcttagttgccttgttcttgtcatatatagctgctgtattttctccttcaccattatctgtgggctcaaaagaaccaagagatgccccagtgaattccctgcattctagacacactccttactcttcctaatgtgtagcagctgccctagcttctcatggtaaagagggcctaatatttctcaatagagaaactcctttatttacctatttgtcctctagcatgagaagctcaaatgaccaggtggtcattatagtatcaacctccctgtattggaggaggaagaagtaatctttctcctcaggaactagtaccattaattgggcaggaatacagacaggaagctcaaaatttgaatgttaggttactagggtgatggtgagatgagccaattctatcattgcccccgggttttcagacatgtgtatcctagctacatagaacacaatagcatatgttggctattgattcagctcatatcctttcttagatcagatccccaatcctgcagggctttgtccccaagatggcaccttagctgagtctttaattcattccaccattctcgtaggcagtctggttcttcatgacagggcacatagtgagactagtggatatagtgttcatatgccctttgttgcaccttctctgccatgaaatgcatcccttggttgaggcaatgctgtacacgttttcatactggtagatcaggtattttataaacccttaaatggtggtgccggtggaggcattgaagtcagagaaggccaaatccaaagtaatcatgaggttttaaatgaattactatttcttacagggtggaaatggtccagtataatcaaactgccaccaaatgactggctgttctctttaaagaaatgtgccttaccaagggtgcagcaatgggctatactgctgaaaggttggtcatttacaggagaagtatcttgattagacttgatgaaaaggagcccaagccattgggtccatgcttggcttccattcctgtcaccatgaccacttcattcatgttcatttctccaaaactggatggcatttataaaatgagtcatctagtctacctgggtgttgagattcaccgcaaaccagagtaatcagtggatactctctgatgagcattaacgtgagacacaaaggtccacagaatttgttcccacccccatagatatagccatatttgtttcctagactttcttgttctctgttttccaatagtattctttctaggccagtggtcaaccaggtaaattacttgctacttcttggtattccatgtatacccttgccacggttctttctcccttcatacaaaaagaatgattgctataatgctcacagatgaactgactgtgaagatttcccttcaccactatcctttagggccacccttgagtggggctgtaatgcagcagtagttcattttttttggctggcattagcttgtgccaatctgtaaagcagacaccaacctatgaactccatcaagtggtcatatggagctctccatgaagccaatttcagtgagagtgcagcagaaataagtgaagtgggagtctaggccacctattcatgaatttaccttccctttctagactttcttgatccagaatgtaaaatttctatcataaaatcaattgctgctgtgctcaccttattttatgtagtagaactggcaatacccaattcacaatgggcagctgtagtcacagagtcacttagtgtcccattgaagagatctcagtctctactagggcagaatagcatgtcaggaattattttcctcataaagggtatttctgtccttcagaaggcagatccttgctccaaaactttaagagcctgagctttcattctcttcttgggacctgctggcgagtccacagaatatccttgtccaggatggatatctgtagtgttgtaagacctgctgggctgggctgtatggcccacatggcagggaagctggcatttcagcctgaatctgttatagactcttgtaggtcctacctgaaactggcagccttctgagttatctgataaatgggaaaatgggttacactgctgccaaaagccaagacgcccagcaagtgctgtacttctttgtaaaaggtagaaagggcaagatacaactgtatgtcctataccttagaagggatttttttgtgagacagggtctcactctgtcacccagactgcagtgcagcagtagttcattttttggctggcattagcttggcttgtggcaacctctgcctccaaggcccaagcaattaccctgcctcagcctcccaagtagctgggattacaggcacatgccactactgcccggctaatttttgtatttttagtagagacgggtggccaggttggtcttgaactcctgacctcaaatgacccacccacctcggcctcccaaagtgctgggattacaagcgtgagccaccatacctggccagaagggattttttagaatgccgcagactaagcatgttgctaatggaagaggtccctgaatctttgtgggatttatctgctgcccccaaccttcagatttcttactagactagctaggcttctttctactttttgcccaccaactctaattagcatatcatcaggtagcagaccagtatgatgatgtgcgtgatgtccagattatccgtccccacaaactcttatgaaatggaaccccttgggcaaagcagtgaattggtattgctattgttcctagataaaggtttactacttttgattctctctattgataggaatcaagaagagaacacattcaccagattgataatcacatataaagtgctacaggctgtgctgatgtgttccagtgaagacatatctggcacagcagctatgatagaacctacctattggttaagtttgttaaagtgcattgtcattcaccttaatctatttgtttggggtttttgttggttttgtttcttacagggggcagataggtgaattgaaaggatatgaagcaccaccattctgcatcctttaagtctttcaagttgacactaatatctgcaatttatccttggacatactcctgtcagtataagctcaaaccttgtatccaatgatcttcaagaagccttggatttctgtttaccagttgacagttactttggcaactggccacaggtcccttttaggaatgattgggggacagtcaccaataatacttgtagtggtatacactttccctacacttccctagggggatccagcaacacttttaatcaatgaattcctggttcctgagacattaaagttttaaaatatgtgcctcttaagatgatgaaatatagtaacttgatgtggttactatacacagtactagagggaagaattttccataacacaaatgtttagatttaaattcatgccttgaagccagataaatgaagtataagctataattacaaaacacctagttcttcagtgtttggatttatgaaaattgccatgattgttatctattgtgagttattaatccaagttacttttattacattttaacagttttagctataacataaattccatgggttttcgtttttgttttttgtactaccttaaaaaaacctatcattgttctgtggggttttttttgctcagttatgtgtttgtatcagctttatgcccagacccatactatatgtcttcacatataatatctcagtgttcacagtggtcttccttgggaggtgtttgactctcatttagatgcaaaactgagacccagaaatgtcatcttttttgacttttatgtcacagctggtaagtgaaagagtcagaattcaaattcatgtctcccaactctaaacccaaagctccttctactattccatagctatcttcctaaatctggtctattttctctccctctccctcccctcctcctctctcagttgatgtgaaattcacacaatataaaattaaccattttcaagtataactaccattcagtggcatttagtacattcacaatagtgtacagccagcacctgtatctagttccaaaatattttcatcatctcaaaggggagctcgtgccgattaagcagtcattccccattccccactcctcccagcccctggaaaccaggaatctgctctccgtccacatgggtctacctattctggatattttgtgtaaatggaatgctaccttatgtgacctttgtatctgactgctttcacttagcataatgctttcaagtttcatctaaattgtagggtgacaaagagtatgggcaatcagacaagtgacccaaagggaaaacagatgtaaacaggcctggctaaagcttgcagcaatttttggacaggttcatttctaacacatcaatgtagatagcagccccattccatgctgtaataccttataccttagatacaaaaatctgaacatcaaaaaaatctgcgtacttggccgggcgcggtggctcacgcctgtaatcccagcactttgggaggccgaggagggcggatcacgaggtcaggagatcgagaccatcctggctaacacagtgaaaccccgtctctactaaaaatacaaaaaattagccgggctaggtggcgggtgcctatagtcccagctactcgggaggctgaggcaggagaatggcgtgaaccccggggggcggagcctgcagtgagccgagatcgcgccactgcactcacgcccgggtgacagcgagacgctgtctcaaaaaaaaaaaaaaaaaaaaaaaaaatctgtgtacttattctcagaggcttagagctaccaaacatactttcccgtgtcgaaaggttttaagagttcccatcttgtgaaggaggctgtttctagccagttggcagaggaacactatgcatttatcccttctggatctcatggcaatcttaggcaacatttctagaaagcggcgacttaatagcaatgcatgaagccattattcataactcttttagagtcaatattcatgcaaagggcttttctctgttataaggaagctgaagaacaattctaacaatatcctatttctatcgatgtttcttataataatattggcttctatgcctttttttaaaatctccattaacaaatttaaccaatgtgccaaggaagaaaatttgctgtgaattggaaaatgtttaaatgagagacataaattattcttcaccttatgtttaccagagcttacttctcagttatttttccccaacctgctttagatgtggaggcagaagaggtgtggtataattcttatctcccaccatcgccctgggtgggagattctatttactcaattcacagggtgaacaaactagtaagatctgtaaaatctgctctccccacaatgagtgattatacggagctcatgagctaatgctggtagcatgatgtaacagaatacgccttgatcacaggttagctattattactaatgcggtggtaggtctgagagcctgtcagatgtggcctgatttaaccctcggtgtgagcattatatcaatttgtggagggcaagcttccatgcagggaccatccagcagctgtttggcatcagggttgcacagctttattaggaagagcaacacttgtctacttttcaaaggggacattttaaagacttccaagagttcttatcttcttccagatatattcattcccagtagggtaaagggactgaaagtctaactagggggtctctgtgccaatagagcacataaatctgtaagaatgatttatctgttctgtgtcagagtttggctgaaaatcctgttagtactgccaaaccctccagatgcccatatttaatgcttggttggccttatgtagcataaccaaattgccatttcacaaccaccctcaatccctggaatctaaaacaacaaagccagaagctctgaaatgtgctttatgaagcatgaaagaatcttttaaggctctgtctgattcatttctgtgtgatgatagaaggtctaatgtacttgtgaaggattccttttactcgtaagaaacttggcactttatagaaagtatgtatttcatgaccaaaaaaatagggtggcttggagggattgtgctttctttttgtattgtatccaatatgttcagtatcaacagcagcaaaataaagaggaaaaatatctggtataaagctatgtcagctaaaagtcacggtgaagagcagaggacagttttccactgaattcagggaaattattgcatgactatgtgaaaggactacttacacagtaagagtgctaagtagaaatggacagtggaagtcaggagaccttccataagtcctaagaatcttagcaaggcacataatcattctgtgtcttaccttttgtatctattaaaggaaaaccataagatggtcatgtcctatttcagagaactgttaggaagaccaaggacatcattgttcaaatgttcatggagctcttcctattcagggacaatcttccccattcagcagagtaagactatggcaggttattgtttgtcacatattttgaagaacacaaatgtattatacagggattctgaaagaacttgactattaaaacaaagcaacacaaatgaagtatttcatttaaaagaatctacacccatccttttcttctccacttttgtagcaatacaaaatgagtccctccacctacatccatgttcttttggtttcctcaccctattttgactttttcctccctctcctactctctcagatgcttttcacagctatctaaacacactcaagtatctttcctctaaaaaaatttcactccaatacgttctcacatttgcgtccacctaccactccttccctgcctctatccttcccttcacagctaaatgttcataaggagctttctcatgttgctcttctgatttttttactccccattcaccatttagcttggtgcaatctggcttttgcccccattacttaattgaaaaaggtcttgccaaagtcatattaacaacctttgttgcaaaatccaaaggacattttagattctttcctaagttgaatgctcagtagcttttgtcactgctgactgcttcccttggttttctccacatcatactccttgattgcctggtgccttacttcaggtcttctgagcagcacaggaggcagggctgctgttgcataatggggaggatactgagctggttaggtgtgccaactgcactccttgcagcttaacagcaaatgcattttttttttttttgagatggagtctcactctgttgcccaggctggagtgcagtggcacaatcttggctcactgcaagctccgcctcccgggttcacaccattctcctgcctcagcctcccgagtagctgggactacaggcacccgcaaccacgcccggctaattttttgtatttttactagagacggggtttcaccgtgttagccaggatggtctccatctcctgacctcgtgatccgcccgcctcggcctcccaaagtgctgggattacaggcgtgagcaagtacattcttaaacgaagccctcacttccacaacagccacagcccaccccttgcaagatacagatctggttctccacatacctttggggaacaggttatccaggattccagtgggcctgtcttcctgaggagaagcttgaaagaggtaacttagggagtagtctgacccctgttgcagcggttggtctgtctgggatcacaattggtacttatcatctctcttccactgttcattttaaattccccctcagctttcacctctgctggtcttgatgacttatctgctgatatgatcaaagccttcatttttgagggcctgaacccatagttaccatacttttcttaggctggggttattgcacttgtttgtctatagtcacaattgagcaagtatgtccaactggatcatctgagttccaaatatatttctccctgtcctcattgtgtaacagcagccctgcttcttcctcctgatcagggtcagttactcctaacaagatattgacttcttcagcctgctggtctctgtatacaagaagtcctgaatgcccaagtggcagtcatagcctgagttctccacagagcctagtattataggaagaggaaacacagactctttcagcgaatcattgaatgtgataagtggactctctcctgcttctgcccaatggttcccagaccaatatattcttcctaattgggataacatccatatagaggtttgtgatgcagtgtctagcctgcatgatgataccccaccatggcagatgccatgatgtaggcaattgcctacaaattggcattccggttgtgcctttggtaggctcttgcattgctctatagagctaccttctctggattatgtgatatgtgataaaaccagaggatcccatggtcacaggctcattcgtctcctcctctgtgaagtgtgtctctcatggtcggatgctgtgttatatggaattctatgtctgtggatcactttcaaatcctccagctagtagtgctgcctgggactttgtaggtaagaaaggcaaacagttatctagaataaatgtttactaccatgacaataattcacaggtccttccaggaagaaatggctcaatgtgtcataaagtggccatgtgatccctgttgtactgctcaggtttgatccctggtataccactttccactagacaaattgctgctgagtctgcctgacattctgacttaatgtattctacagagctcagctcacaaggggcagtttagaatgcatagttactggcttccatggtcaaatattcagtctcaaacagggctcagtagcaccccaagagatgtttttctgcactgcagatggtgtggactcactctagaaatccagagtactgtattttgattcttctatgaaggcttgccacaaactccacaccaaactacctcttttttcacttttcactcttccaacacaatagagtctatgagatcatatggcccaagaggcagggctgcttgtaccacagcctggtgctgcaaagtcctgctcaggccctattccaagttgccagacttacatgttaactgatacatgggcgaagcaatctttctacagtattcaattcaatgaataaatcacagcttatttgtccattttcttagatataaacaaaagtataactcttaactgtaagttctgagtttagtcttcagctctttctaatatccccttgcaccagatataggccttctcatacagtgttcaattgcttgtcagttgctgtcaactttatctcagcattagctggctgtagtagcttcaaacttaacaaaaatccagctaattccttcatccttgtattcattgctttccttcatcttccttgcctcctcctcaacaacatccctccaacacacacacacacacacacacacacacacacacacatgcatgtgcacttttctaaagcatgaacattgcacaggccaggaaagttctctcacggaactttcttccaagccatcattgattaaagtttttagtaattgggctgccaccctgtgccagagactatctgtgccccctgtgccacccagaatgggatcctcatcaccagcttgcaggaagtgatctgctcccaaaacctcattttacctcctgctttctcagaccaattccagtaccaactgtatcagttcagttattctgggaagcagatgctgagacagcgttaggagtgcaagtggttcattgaaagataacatctgtgaaagataaagggggagagccccagactgtgctacagagctgacaaaatcttggccaaaccaatggggagctctagagcaaagactgcctgttagagggacccacattaggcatagaagccaggctctagcaccactgccatgctcagccctgggctgtgggcttcccgggaagagtagagccttggttaaaacactgtgacagttcctgcaggtgctgcagatggaggctggcagctaactgcctcctgacagttacacagaaagctgtttcctggagggagatctgagtggtgcatctctgtggctgccatacccattttctctttcatcttctctgtttgcacatctgcctttctgtaccagcttctctttcttcctctacctatcatttaaatgatgctggatggttttgaggttcttatctcatgccacacttctccagcctcgcctactcccattcatacatctaatgagattctaatgaatttgaatttcagatctgtaagccaggtctcttttctgagcactaaacttatttcatccaattgctcactaaaatatcatacagtgtccttatatttaacatttccaaaggtgacattattatcttcttggccaaaactatctgtatacccatctcagtgaatggatccatcggttacccggatgctcaaaacagcatagtcatctgcaacaacatggatgaacctggaggatatcatgttaagtgaaattggccagacacagaaagacaagtggtgcatgatctcatgcatatgtggagtctaacaacattgatctcgtagaagcatcatgcatatgtggagtctaacatcatgcatatgtggagtctaatgacattgatctcatagaagcagagagtaggatagtggttaccaaaggctgtgcagagggtagggggaggaagaaatgaggagaggttggtcaacaggtataaagttacagttaggtaggaggaataaattctgatgttctattgcacagtagggtgactatgttaacaataatgtattgtttatttccaaatagctagaagagatgatgttgaatgttctcaccacaaagaaatgataaatgtttgaggtgatggatttgcaaattactctgatttgatcattatacaatgtatacatgtatcaaaacagcataccgtattccaaaaatatgtgctaattaaaaataagagaaaactaaaaacataaaatcagtatttaaagacaaagaaaaacagacacataggattattcttgatactttcttctcactcatccctaatatcaaatccattattaattattactagtctaaatatatcttgaatctgtctccatttcatttgttttcatctgagttctcaccactaacatttttttccacctgaatggaaatggagtttcttttgttcttgctaaacacagcagtgagggtgatcagcctgtactgcggatggggtctcggtctcttgagtaaaatacgctattggcttccattgctcttcagaaaatttcagactcttcacatggtttatgaagtccccgtgatctggccctgcttgcttctctttgcaggcagatcttttactagtttccctccactttagtcacttctattatttcagccactttgaactatttttatattctagaattttatttcagccacttcgaactatttttacatcctagaatgtgtcattcactctgctgctcttattgcttgcacaagctattcatttttgtgggaacattctttatttccactcttttttttctataattaacccttttccatctttaatgcatatgaaagcacaaaaatagcaacacagataactatgtgctaccatcaaaattaaccagaagttaacaattggctttaacttaggtttctcttttattttttaaataaataaaatgttacagcaacaactaaagctctgccactatccactttttccttctctccccacgcagggattaagatagaattttactgttattgtaccctctcttgctgttaagaaatctgccaccagctcagttatccttctcttgatgttttcatctttgacttttatttgcttttaagatctctttgtctttaatgtttaacagttttcctgtaatatgtgtagatattgatgaatttttatttaccctgctttgaattcattgttctattttgaatgagaagttcttagccattatctctttaatattgtctgtcctcattttctctattcttttctcatgtgagtcctattagatgtaagttggatcatccatctttcattcttgccttttaacttctcttttgtgttttctaatatgatatctctctgtgctacattttatctggtttcttagctttacatatatttccaggccactattcttcagctaactactcttctgtctaatccatttctgttatatttcggttgtctgttctgtttcatatatctgttcatttttgtggttttgatcatgtcttttatgtcctgaattagtttttaaaaaaacttattttataatcactttgaaatcattctattctctgtaattcttgggggtgtcagtttgaaaactgtgagatcttaatggctctttcatggtgaattgttacctttttattttataatttaggattataaactcatttatcattgagaaaatggctcaaggggagttccacaattgtttccaacagcaacatcagggatttcactgctcagggatatattttatgatactatctcagcttgggaggtgtctcagccatccagtagtttaaatgccaaccaaaacacacaagtttatgggcaagggcatggttccagattctcaagaaggtttttttaaaaatagaatattgagtttgatgcagtggcgtcaggagcaggacgactctttgccattcagatcatggggaaagcagtgggaatccaagtgaggagcagccagaggacaacagaggagaggatgggaggctgatgacctgggccctgggcgtgtggaggctgtgactcttctctagctagaggactcttcttttgtgggaaggatagcatcttctgaggacccttgctatgtgagcaggctgacataggtggtgatgaggtctgttcctttctaggttcctgtagagatctgtaggtagctgttcactagggagttaactaagaaagagaacaaaaactattcatttggatccaaggtccatcaccgctggtagctgtggtggctttggattgtcggacgaccatcagcttcagcaggtctgcactagggaacaatcattcttccctagcccaagcgtgcctctgccctctgtatcgttgacagaggctgcatgtttggcaagagaacatagtgactgctgaactgaaagttgactctaactctcgctaccaagtttttccctgacacagtgaaagagtattaagacatcagcctaggacaccttgagaaccaaggacaagatggacagggccaagtaactgggcttcaaccatgactgggactaagaataagacaagaggccaggccaaagcggaaaagagtctgctatacaagctaaagctggagaagagagggaggctacgggtgtggttaggcctgtagccaatacctgggccaaagcaaaagacaagccagggtctctgacagatgcagtggcagagatgaaggcagtgtctaagaacaaggtcggtgctgagatgaaggaaggagcccctgtcagagcctaaggctctgggcaaagccactggagatttcagtcccgaggctgggaatgagtccaccagctccacatgtaaaaatggggctggtattgatgcctgggtctgggctgaggaagaggccactatcaattcctggttctgaaatggagaagaggctggtaatcattccggtgctaagaatgataaacctgaaattggtgcccaggtctgtgctgaggagttggagcctgtgactggggccagttgcaaacctaggtctggggctgaggaagaggaggaagagaatgtcattgggaactggttttgggaaggagatgatgctagttttgaccctaatcctcaatctgtgagtaggatagttagatctcagcctgtggatgaaattaatggaaaaaaaaaataggcccaaggactggtctgaggtaactatctggcccaaagcccctgctgtaactccagcagtattcggattagatcccaggcatctaaggcaagccctccttcatatattgttttggcctcagctgaagaaaatgcctattctttgcctgtggcaacagcctgcccttgtaggaacactaactcatgctcacagcccatccctgagtgtccttttggttccgacccttgcatccagaccatagatgagattagacaccaaatcaggattagggaggtaaatgggattaagccatttgcttactcttgcaaaatggaatgctatgtggactctgaggaatttgaacaacttgttaacttacttaagtcaactactgatcctcttgttcataaaagagcacagattgcaatgggtatccataacgttcacccatttgcccaagagtttattaatgaaatggtataatgatgcttattgaaagcttgctcagttttccttccccagaaatgagaaaattactaattttcttatgagtaattactctgaatcctccttctggggatgaaagacaatgcaaaattgaattacatgttaagcatatgtgtaaagacaccatgtcatttcctttgaactcacctggacagcaatctggatcaaagatactagggcaactgactactgattttgtccatcactacattgttgccggtgacttttcagagctttttcatttgccatccttgagaaagtacaaaaccagacatcttgttttgaaagtaattttaaatatatctgaaaatccaactgcagccagagacatgatcaatatgaaggcactggcagcatcaaaactcatctttaaccataaagaggcaaaagccagtcttgttagtggtgtggccatatttattaacataaaggagcatatcagaaagggctcaattgtagttgttgatcacttgagttataatacactcatgggcattctcagggaagttaaagggattattgaagcaatgtaaaatgagccagagatagaacactttgaaccatctccaaactctagcaggctgtacattcccaaagagccttgtatcatatttggttattatggtgtacaagttatacattgcatctttaacacatagttacctgtgacaagctctaggtttgagctaaactattttgggggtatcagatgaatatcatatcactggctgaaaatgtttgttgatttttttcttgtttagattggcatattttttacattttatttaagaaagcgaacgagttcgttgtaagtgagctaacttgttcattagtatctccttagatccatctgtggcttaaaatggcaaaaaagaaaacatccttgaatttgaaatctagttatagaagtaaggcatacacacacacaaagataactaacagtacctagagagagagtgagtgtgtgtgtgtgtgagtgtgcacgtgtatacccatgaccaaatgtgcactctctacataaaggaggcaggggttgctataggctgtttaatgtaagagaaactactctttttctcctattccagccgtatcagatactcattccacaacacagaaagatccagaatttcagacaaatgcattatttgttcaattttaattttgcttctacatttataactcttaaattgtcaggctgtttcatttatgtcaaagtcatctcacaaaagagaaggtggaaacattttgtgagtgcctattctatgtcagacactaagttggcaccatattttgcaagtttatttttttcctgtactcacagtgatcctgtaaactaggtactcgtgtttttattagaactcattagtctgggtaccctccaatgagaattagagagggtaagtactttttcctagattcccacagcaggcaggtggcatagctgttttatctgacaccagaacccatctcaccatactcctttacagttcccctgaaggacattttgaggcgacggccttcaaagctcagagactggttttaatgtttaattttgcatgccaggttacaattcttaacttcctccacatgcatgtgtccatcagacatttgactgcatctggctggaggtcagctgaaaagtctgagatgagtagatggattttatctggcagtgtcagaaaaatagtaggtgccccaaactttgttcagtgagtaagatggagatttggagtcatcagcaaggggaacttgttagatgtcctttgcatctttttctacccatttgtactttatcttccccaaagagctgaaatcatcctgtacattgttttatatcctgaattaaaaaggtaattgcttttggccgggcgcggtggctcaagcctgtaatcctagcactttgggaagccgaggcgggtggatcacgaggtcaggagatcgagaccatcctggctaacatggtgaaaccccgtctctactaaaaatacaaaaaattagccgggtgtggtggcgggcgcctgtagtcccagctactcaggaggctgaggcaggagaatggcgtgaacccgggaggcggagcttgcagtgggcggagatcgcgccactgcactccagcctgggcgacagagcgagactccgtctcaaaaaacaaaccaaaaagaaaaaggtaattgcttttttcctccttgcaaaatcatgccttaattttttttatcatttgtgatttattctcctatgtgtcctatgaaaggccaaagggctttatcttttactagtaggcaagcctgggcatttctgcatttgtaccggctaacacgacagaataaatgtaatcggagaaatttagatccagaattgcagcttcaacaatacaaaacagcaaagctacaagaggctgctgtgccaatctacaagacagtgattcttagtcgttggtatggaccagaaagcatgcccaggacgtttaggttatggctgaattctctaagactcatggtgggaattgtaatccctagtctgagctgaaacggaagtttctatgtgtgaaaatatggggtaatatgctttgaggttttctgacagttaagaaactaagacaagatcatactgtaaatatgtatggaacttgcttccccccagttgtgtattgtaaacatctttgcatgtcaataaatatgcctctataacaacaacaacaacaaaatagaatatatacaaggggtatgcaaactttggtcagtgggaagatctttgctgactcacattttcattaagtgtatagcactttgacatccctcattttgtagcaatatcttaattccaactcttcctgtcacatgtgctgacatctcttcttacctcgtgtcagcattaaaatccaaactctcagcatcctgaggctggcgattccttccccatgatcatctttctacttcttgagcattcacagagcttgttactctgttttcagttctttcataatatctggggagttcctggatttctagagagttcaggtattcatttgaaataattgttatgttttatctaacatttatcagtggtcatagtgggaaggtttggggattatgtagacttccaggaagtcttcatctttcagttcctagattattcattgcccagatatttattgtcttggggactatattgggtattgaagagagctggtaaaaaatacagatagagagagatagatagagatagagatagatcctacactattaactttacaataaaattagacatcagtttctccaggaggctttctctaacttttctcaaatctcaaaattagctattatacgtagctaactcactgtatatttcctcattctgtcattcttttttttgtttgttttttgtttgtttgttttttgagacagagtttcgctcttgttgcctaggctggagtgtaatggcgcagtctcggctcactgtaacctctccctcctgggtccaggcgattctcctgtctcagccttccaagtagctgagattacaggcgcccaccaccacttcctgctaatttttgtatttttagtagagatggggtttcatcgtgttggccaggctggtctcaaacgcttgacctcaggtgatctgcccgccttggcgtcccaaagtgctgggattacaggcgtgagccactgctcccggcctcattctatcattctatcacactattttaattatatattaatttgtctgtatcatcttcaagattataagttctgagaaaatggtaaagcatgtccttctgattcgttattccacagtgtcttgcacaaagtccaccacattgcagaaacaagattattattgctgaacacagttgcttcagaaagtacttgagaattttcagtatcttttaagaaaattcaattggcctgtttttcccaacattcatgcactatcgacccttcctttttcttaagtttgttcttctctgtatgtaaattatctcaagcctcctgtatccttaaaaacaaagaaaaaaaggaaacagtaataccttccctagtttcctggatctaaggattgtattctgtatctccttctgtcaaatattacacagtttaccattcctgcatttataagctcttttaaaagccagccaaagcaatcctggtgcttcccagatgccagttccacaggaatattggtcccccatgaggcaatttgctaaagcactctggctctttcctgatgtctgcacttatgactcatggctgatttgattacttcccggtgactccctgaatcctttgcttgtttctatacttcaacgctagttcaattttcttacattaattatgttttaagcattaattatgttttaggcttgattcaagtcttatgctgcatcccacactttttaaaaaattaaaaaacaaaacatttttattgcatcccatgcttttaattgacagctcaattcacctgggatttctccatcaggtcacgcagctctgaaagctctctattgcccccttctggtagctggcagactagctcctcaattagcttacatcgtcaatgctaaccttgttgcttgatgttgctatgcctcagatactagtatcttcctttctttcctatattcttcactgccgctgtttcttcatcatctatttattcctcattcctttcagactgacttctgctgcctccagccttctaccaaaacttgccatcccattgatacaaggccctctcaagtcttctggatgatctctgtatatgaaaatattgcccttccctttcctacttcgccccaacactttattctaagaacttgaaattctattagaaattatctactctaggagtcttcaaatttgacaacagattaaaattgccaggacaacttaaaaatactgtttcctgggcccccttcctgaaaattctcaccttttaggtctgaagtagaggtctcttttgacctattgtcatcattaaaatcccaactcccatttgaactttaatttaaatgtatttattcagttaggtaaatcatgcattgggtaaaaatttaaacaatacttaaatccacccttcctgtataagtgttcttacaagctatagagaaatacctgagactgggtaattgataaagaaaagaggtgtatttggcacagagttatgcaacctgtacaggaagcatgatgctggcatctacttggcttctggggaagcctcaggaaacttacaattatggcagaaggtgaaggggaagtaggtgtggaggaagggggtggggaagtgccacacacttttaaatgaccagatctcatgagagctcactcactatcatgagaacagcacggcaggggagatctacccaccatgatctaatcacctcccaccaggccccacctccaacattgaggattacaatttgacctgagatttggacagggacacagatccaaaccatatcacttccccttagtttccttacatttcctctcctaaggcaatccttgttaacagtttcttaaggatccatgtaggcacaaattccatattctaaagacatgtctcaactgatttggatgcatttggtccactaagcttgaggagcctctgatttaattcacccctctcatcttccttgaaattctttcatccttcaacatcctttatgctgattgtcgaacatctctgatagtttgattctgtcttcttggtccacacctcctactttttctgactgtttaatgtgggcattcccccaaactactccccttgatcttcttttctgtctatattttctttcttgacacatctctccagacctatgagtcactcacagaatatactcatatcacttgcgccaacatctcaagctagccacacaccagtattttttctaccagttagacatttctgtctagttgtctgggagcacctcaaattcagcacccaaaatgaacttacctttctgttaacaaaactacttatgcttctcttttccccattgtccttacttctgttatcattgactcttcctctgcctcttttatgttaattgcaccttgaaatgacccacacttcttttccctccacttcagtttcgtttgttacagcattttttacactagcttcacttgtggttaccacttccctgcccactgctcataagccccttgaggattcttcagggcagcaactatattttctttatttctatgttctcggcacctcactcattctctcatagtaggtgttccatggatatgttgggtcaatgaatatccgttaaagctcaaatttttaacatggcagtcgacatcttccatttctgatttaccaacctctttaatttagataacttaatttacgccttgccacaaccaaactgaactattcacagctctcctgaatgcacattgcaatcttccttttgcacttctttgtttatgcttttctttctgcttgaaattcccatctgttccctgcctatcaaaatcctacaaatccttcaagtctcagatcaaatgccttattcttcccaaagccttcccaaatccttaagtcctgggttcccacagcgtgtggattgcattttagtctcacttctattcgactaaatttataaaatcatcggattttagttgtggaagacactttagaggtttggattttagttgtggaagacactttagaggttacctaagacaaccctgtattttacagctaagggaactgagacccagaaagagtaaatgtcttgctcaagattaaatatcagccagcgaccaacggagccagacctagaacccaactctcctgaattgttttccagagctatgctgcctatgcaattgttttagcttctcttccggaccattagtgccaaaagtcaaggattaaattttattcagctttaattccttataatatccaatatagcacctttcatatagtaggttcacaaaagctatactggattgaaatgaacatttaacgtactggttaatagatatttttagccagagttccctggaaaacagagtgtgaggcagagattacttgctgatgtgagagtaaggagaaagaaaaggcaggaagggctaagggacaatgcagtgactactgcttcccagcgaacctggaaacccagcagggaatgtggcaagtggtctgtacatccaagcaaggtatctgtggccaggctgtatggacctatgccttggggcagctcataataagcaacttactgtccccatatcgtctcatatcttttttcccaccgatcaaagttactcccctgcacttccagttctgtcatctggcccctttgatggctctttggaaagccagattccatgccctgcgggaaggttcctcggttgagtccagagtggaagaggatgcaaataagatatgtccaataaaaaaagctttgaacctacacctgttacttaaccctgttacttgagattgttcctattttggtttttgaaatccattgatgttggaaacacaaaactggtgatggctttctttaagagacaggctgaaacagaattttttttttttacacggagtttcgctcttgttgcccaggctggagcgcaatggcacagtctcggcttaccgcaacctccgcctcctgggttcaagcgattctcctgcctcagccttcccagtagctgggattacaggtgcccaccaccactcctggctaatttttatatcgttagtagagacggggtttcaccatgttggccaggctggtctcgaactcctgacctcaggtgatccacccacctcggcctcacaaaatgctgagattacaggcatgagccactgcgcctggctgaaacagataatttttaaatgttttgtgcaagttaacagtgacattcatgaagagaatgattaaagtacagcttgaataagttctgatttttctctcttaagaattatgtgcaaatccatatgtgacttttaaaaatcatcagatttcaatgttttctcatatgatgttatgattctacattaaaagaactataaactcttctaattaaattactcaagatagtgcaaaagaatccatgactctttgtcctcagatataactcgtaccctaaatgcaagttgtttaccagtgcacatgacaaaaaacacctaagtagggggaagaattctttctttcagacaagtggttttacctacttaaaaaaaagccttgaaaacttggacacccttcaagagcctctgaatatttttcttcagcagaaattccagcccagatgttcaataactcaggtttgttttaaaagaggaaatagagagacaaatttttgtgaagggcaaaatttgaaagcaattaatggtgacatgtcccagaattttgcttcattttattattaacgcaaccattctttccaaattttattgtcagatattggagaagagagaggaaaaaagtctgggaattggagataaaattcaacattgaaggagacattttaaatcccagtcaagaggaaagaaagagttgatggctaagctgactgccaaaagacattgtaaagttaccagataacaacaagtgataatagaagggcctagggaagttctgctcatagacttcaaacttggaaaggtgtcctgcagaccaaaacctgctgacctagcagtggcaaagttgccttaaatgaattcacaccgacaagcctggagggattgtctcttgatgctaaagtgattcggtcatacatatctgagggcactaggtgaaatttctggagaatcttggaaaataagtgtgggaccagaaagatagaatcactttgttctggtttactttaaaaggataaaaggtgcttttcatttgctggatcacttaaatgctctaagtctctggttctcctataaactggggactatttactagccccatttatttaccagaattgttttgataatttaaaaaaaagatatgcaagctaatcataaattctaaatcaatataaaaatgggctgggcgtggtggctcacgcctgtaatcccagcactttgggaggccgaggcgggcagatcacgaggtcaagagatcaaaaccatcctggccaacatggtgaaaccctgtctctactaaaaatacaaaaattagctgggcatggtggcacatgccagtagtcctagctacttgggaggctgagtcaggagaatcccttgaacccaggaggcagaggttgcagtgagtcgagatcatgccactgcacagagagactggcgacagagagactctatctcaaaaaaaaaaaaaaaaaaaataagctagtgagtgactatttaagtctccttcttctttccattttcattgcactttacacatactactgttgtagatcttactgtgttgcatgatggagaggtttatgtccagtttcccaactggaatgtgagatactcaagaggacagacgtcaacttatttttcatatgacccccccaaacccaaaacaaggattagcatttaatgagtgcttaacaaatgcttgctgaatgcagcaagattaaaaaataatctcagcagactgtgctgcaaaacagaattgcaagatgataacctaactaagataaatataaaccctacatttgactctaaataataaattgcacaattattggattgtaaagtcctagtccagaggtcatggtaaaaacatctgggagctgcagttaactataaaaacaggaaagagaccgatgaagcttctaaaaatattaacttattaatactagcatagaatcatgggaaatgatgggaaccaagagaaatgatagtctcactgcgttccttgtgggtcgaatcacattttaagaggaattgataaactagagtaaattcaggtgactccatctaataggatagacagtaccccatgctataccaaaacgagttaaaagagctcaagtagggctctggggaagagaaaaataaaatatagatttgagctgtcttcagttatttgaaggagatccagtgttgtcccagtaggcaaaacttagaccaaaaaaattgtactcccaaatttgattatcacatatcagatttggattcagtaagaagaactgttctaaagatcacagctgttcaacaatggaatggactcctctggacggtagagagattgtgtcacacaatacctggggcttagacatttcttgtaatcctgtctgtacttagcatagctctggacacacaatccatagtcactaaatattttttcacagattgatactagggaaaataataatatttaactatgagtatatgcctactctgcccagtaatgtttagtattgaaccagagatctagattagtgatctccagatttaattcattatatactcctatcagtaaagtttttgaacaggtactcctaatatatacatttatttataaattctatactatactactctactaatcgtcatatcaaatacatgtttataaaacaaaaataatgtaagggcaaaaatatgagataaagaaaaataaatgttaatgtgttttctttctgcacaccaatggatcatcatggccaccccactttgcagagaactggtctataattaagggacttaacatctgcctcaaatacctggatattttaggcccttctgagtctgaatgatctacatatcaatcttaattttttcatttctcttttcccatgtagacaaaaacaggattaaaaaaaaaaaggttaagcgatgttctaccatttctatacagttgacccttgagcaacacaagtttgaacttcacaggtccacttatatgaggattttttttcaataaaagtaacactgagtatgctgcctcttctgcatccccttgcacatcctccatctcttccatctctgacacagtgagacagcaagaccaacccctcctcttccttttcctccttcttcaacatgaagataacaaggatggggacctttatgatgagtcacttccacttaatgaatagtaaatatagtttctcttccttatgattttcttaataacgttttctttttttttctagcttactttattgtaaaagtacagtttgcaatatatatgcaaaaaaagtcttcactgactgtttatgttatcagtaaggtctctagtcagcagtaggctattagtaatcattttaaaaagccacttatagattcaatgctattcccattaaactacctttgacattcttcacagaactagtgaaaaaaaaaactatttaaaaatttatatgaaaccatagaagagaccaaatagccaaggcaatcctaagcaaaaagaacaaagctggaagcatcacgctacccaacttcaaactatactacagggttacagtaaccaaaacagcctgatactcgtacaagaaccaacacatagaccaatggaacagaataaagaacctagaaataagaccacacacatacaactatttgatctttgacaaaccaagcaaaagcaagcaatgaagaaaggattccctgttcaataaatggtgctgagatatctggctagccatatgcagaagattgaaactgaaccctctccttacaccatatacaaaaattaactcaagatggattaaagacttaaatgtaaaacccaaaactgtaaaaaccttggaagacaacctagccagtaccattcaggacgtaggcacgggcaaagatttcatgacaaacatgccaaaagcaattgcaacaaaagagaaaattgacaaatagaatctaattaaactaatgtgcttcaatttactttgttgagagtataaaaaacactatcaacagagtaaacaggcaacctacagaatgggagaaaaaattcgcaaactatgcatctgacaaagatctaatatccagcatatataatggacttaaatttacaaagaaaaaataaataaccccattaaaaggtgggcaaaggacacgaagacatacatgtggccaaaaatcacatgaaaaaaggtgccatatcactgattattggagaaatgcaaatcaaaaccacaatgaggtaccatctcatgccagtcagaatggctattaaaagttaaaagaaatgcttttaccctgttgggagtgtaaattaatgcagccattgtggaagacaacgtggtgattcctcaaagacctaaagacagaaataccattcaacccagcaatcccattactggatatatacccacaggaatataaataattctattataaagacacatgtgtatgtttatttcagcactattcagaatagcaaagacatggagtcaacctaaatgtccatcagtgatagactggattaggaaaatgtggtacatatacactatggaatactatgcagccataaaaaagaatgagatcatgttctttgcagggacatggatggagctggaggtcattatcctcagcaaaccaacacaggaacagaaaatcaaatcccatatattctcacttataagtgggagttaaattatgagaacacatgggtgcatagagggaacagtacacattggggcattttagaggctgggggatgggaggagggagaggattaggaaaaacgactaatgggtactaggcttcatacctgggtgatgaaataatctgtacaacaaactcccatgacacaagtttacctgtgtaacaaacctgcacttgtacccctgaacttaaaataaaagttaaaaaaaaaaaaaagaataaagggtagcaaacacaccttcttgctacaaaagaaaaaaacagtaggctattggtagttaagttttggggtagtcaaaagttatgtgcaaatttttgattatgccattgtcgacactcctaaacccctccattgtcaagggtgaactgtatctgtttttgtaagtcttttatgaaaatatttttaaatgtcagttttttgttgaccctgcatgattgtgatagaatttttctacctcgtgtctccaaaacagatgttgttcccttataattataatacattttacaaaatcgcaactgcagagtgttttgttgaagtgatcatcttaaatgaatgcatgagccgtaaccggatcaatcattcttactcctgtcaagctttcaattacattccagagtcccagcacaaacctagcagcttgttggaacatctagatgccctttgcttctacatcctccctctttcctcccagatttggattacctttaaatgagctattatctgatatgatgccacagtttccatgattcgtattcatttttttaaaactttcgtctatgatctagtaagtgacgatgactggtttattgcaaaattttctgaatcactttgctctgtcagattaagctttcagctaaccagcagagggagcacaaagagacacactggtttcatctcagtgtacagggagtctagttactaagtggacgaagaactcccgcacattgagatctggtcctcaactggcaagaagcactgttcgagcaatcaggaaaatctgggctttaagcagtggcaccactacgaatttattctcttgcctaagattacttggaattcctatagtagtgggggaggggggactctcttttgtactagttcctccttaaattttaaagaaattgagcccgtggactgaggtgggtgcggatggtgggatgcagaggaaacaaaaatttcttctcatctagcttccactccaaatctgtttctcccagagaaaatacaagacttaggagtgctgtatgaagtctcttgctgctctattctctaggaaacctaatatgaaatcattaagctactgaatgtcagtttcttcaacagtaaagaagacacattattattgctgttattattactactactactaccaccaccaccactaccaccattactatccatttagtgacttctgttttctctacttaatctcacttattcagcatatcagccctaagaggcagattttattgctcccattttacagaagaggaactggaggcttaaagaagttgaagaactcaaccaacgtcaagcaactagaaaggaaactggaagaaggtgtctctgattccaaagctccatgcttttcatctgtgttggtaataaaaagaataataccatatcacagttatattgtacattacaaagcactttaacctttatcatccccacctcgggataattctgtgagctaaacacggacaaatagtaacattcacccctccctatctctctttacctctttagctcctatttttaaaaaacaagcaattaagggaactaaagcttacaaaatgtaaaggatttttctaaggtcacatagatgaaaaatggatttgggattaaatgggttttattcctgtagttgccacatcacactgctttgccacatagagaggaagagacccagctttgcctccaactagctcttttaccctaaaatgatcatttaaaccctggagttcttgcatatataaaatagatgggagtaacaataataattaatacttatgttaacaacctcacggtattcacaaagatcaaatgaaatacggagatagttatgaaataagtaaataatatacagacaaatatagttctattgtaagattatcctgggtgttgaaactaggttatgtctgacttctggcaaaattacaggacagggcaggttagtgtctaatctgcctacttcccaatccccaggtagctgtcgcctgaaaaggcatcggaagatacttaagagataggagattgttcatatttacttaattttttggatgagactgtttgtctgaactgtctcatgagatggtatttacctacttgggaagctcattctctcatttgggacttggaagcattctcattgtacaacagtgagagctggaatgccattacatcattatgaaccacccagtgcccatttgatatagttaataacaaggattaatgaagtaatttaaaaggaagaaatagaatccttgccttgatccaagacaaaaggacaaaaaaaatttctttctgaaatttgagggaaaaaatattggttgcttctattcttttaagaaactgcctgagaaaagtcacagtgtgtgtgttatgtgggaaataagagtattggggcaggcaatcattcatatgttagatttctttgttcagatcaatattgtttgagtgctaacactgtggtaggtgctggaaatcgaatgctgaacagaacagataagttgcccacactttcatggaatttgcattttagacagacagccagcaatgatcaaataattacatgtttggtgggtgttacaaaggagaaaaacagacttccattatgacctcttatgtaatcacactgcaatatcttgaaattattacttataaagatcaagcagaagctactgctgcatactagagaattttaaatgatttccaacatcgagaaacttgaatttcttaaggagtagttattataaaaagaaactggaatggctaatcttggctgtctctctaaagccaatataaagaaaatgagtgatacacaacattatcttgacctcactgacaactagatagcctaagaaacagtgtgtgcaatagagtagaaggaagaatcaaaggacatattttataaggataatgagttctgctttcttttcctcttctgggctataataatttttgtctcttttgtaatcataccctcttggaaagccactggcttggactgatttatgcctactacagatttttccttccaaaagtacatctccatgactaaggaaatgggctgtctcaggttggctggttccatcaagaacacttaaaacttgattgcacaattgtaaaaccaactggggtcttagcatcaacttgcattttctcattggcatccaattttgaggatatcatattgcttggagaagaaagaggcagtagttattataatttccgtggacttacagagttttagagacttggatatcgtgtactttaacctcacacccagtgtaagaatctcctatacctgattcatgatattcatcttttgaatacatagggtaaaaagagcttactatctcatttttgaagaattctgttattcttttttatattggagaaaatctaccaccattagtcttagatatgttcaccagagccatcatggaccaaatcagaagtaatcatttctacttaaagactttcctcctcttcaccactaacaagtcttttctcttctaggctaaacattccaggtttttcctccattctgtataccacatgatcctccaaattgctcccattttggatgatggagcttgaggaggtggaagatcaaaatgttagtgtgtgttatctaacagatttgctctttctctcagttttgtaacattagcaggtttgatcaatatttcacctgtgctgcaattcacatcgataattaaactatacagggttgctttaattataaagctaaaagtggatttttttccattaacattaccagataggatgatttgccaactcgttctctgggtctagaaaatgcccaatgaagtcatattgactctaaaatcaagctctggatgtgaagatgctgccatgctgttgagtcaaaagaatatattatttttcatttctgttagaccagtaattttagtaactttggcaaaaggaatataaaaacaagcaatctccaatttatagggctgcactgtagaagtcatttgtttggaatgtatttcacatgagtattaaatttttggggaagactaccaaattttttttcttttttttcttttttttttttttgagacagactcttgctctgtcacccaggctggagtgcagtggcatgatcttggctcactgcaacttccacctcctgggttcaagcgattctccagcctcagactcccgagtagctgggactacaggcgcatgccaccacacctggctaattttttgtattttagtagagacagggtttcaccatgttgcccaggctggtctcgaactcctgagctcaggcaatccgcccgccttggcctctcaaagtgctgggattacaggcgtgagccaccgcacccggccaaaatttttaactcctaagacaactgacattgtaaaccagaatgtcatttccggttctttaacttaacatgtaccataagcaccacgagaaatattttgacatctagcacgatgtttaacaatgtttttctggattcggatgaccaggatcactgctgggaacaccaggaatattttcatgcttttattctctatccaattgagttaaggatccccggccccacatctgctgaataaagaaaactgggatccttgtggcctgaatctggtggtggctgggaaggttaagatgcagtgatagatgctacagagcttctggaataaagcctgcctaccactggggtatactcctcagtcttcatgggtcgcagtcagactcccattctctctttccctccacgtcagcctgattcatagcctcttcgtactcattctctctctctcctcctattctctcttcctcaggggtcatgacaaaatcttccagttttgtttcacttatcccttaagcactctccaatgctttaacagttttctaaggtttgtttttcccttgctgggtagctaatgaattaattaagaggggaatattgctagttgcaaaagggaagtggggtctatagaggatctctccagtggcagcctctgtctctcaatctctctcccattctgtctcacttacagctggcagggagaggcagaatcacctgcagatgctgcctgtgggctgagtaaaatgcaccaacttttcaaggaaaaacaaggacaggcgattctaggccttaagggaaagatggtgaggtaggtctgacatctggcctttgatgagaacacagaacagtacttctttgtgggagttgggagtgagaagctgagaactaacttttatttttttttaactcttaattgcatttattttatgctgaatttattcccatgccgtaagtttttgtttcttcagtttcttttgagatatcttttttttccttatgtacaacagaaatatcatatgttgcagcaatatcagcacaaaagaaacttactgaatccttactgaaaaggaacagattgttccagattacttctcttcaggtttaggaaaaatttgttccttttcagtaaggatcatcttgatgtggcagggagagtacatgcatgggttaatccgaccatgagctctataaggccagtagcaaatcttaggtgctttatttacctgggtatgctcaatgacctgagaatctacatctacacccttaagttcggcatttctctcagcatttataaacatgtgcagcaaaaattcagcactcattttgggccaccaaccctgtgtccagccccactgcttggcctgggcactaccaactcccccattgtaacgtcagaatggtacacactgtttctgtgaagtgacatctttcagatacttggtggcttttcgtacaggcacacccttgttggcctgggcagtttcacgagtgttcttacaggaaacacaactatttgaaattcttgatttgcctgattttgaggggttttctgggtcgagtgaacagaaaactattttcacagatcacctcaggccacttaggggaagagcgggactaactttcttgatcttgcttttgcctgccttctcttttcacaaaggaacagatgttcctttcaccaatctttcaccgtcattcatttttcttcctccccttctaagacacacttggctattgcagaaacacagttccttaaacacaagtccaaaattcaaacagctctgaacattgaaagtttttggcaacctacattgcagcagaatttggcccaaactgacatgaggtgatatcatctttatttactcacatatttactataaaaatatcaattatcaatgggattgttttaaagtacagccccagttcctgcttgagtataatcaaacatatgtatattacctttctaaaatctgaaaatttttgaattctgaaatacatctggccccaaaagtttctgggtaagggattatagccctttatttcctgttttcctacatctttctctttccagctaagtgtaaaagagtatagactctggtaacccaagctgaattcaaatcctatctctaaatatcagttgtgtgtgattttgctctgtttacttaacccgtctgtgcttcagtttccccatttgtaaaatagggataatagtattacctatctcaatgttgttgtgaagatttaattgagttaatctatgtaaagtgcttacagtaatctctagcacatagtaagcactataggtttgctattatcatcaaccttaatccttcactctacccaaaaatattacctaatgtcccaattataaaatccctgctcttcgccctattccctccatagttaaccctctatccattttcttccactcatgccataaacagaaaaccatttgtcattagttaccattgactactcttcaactggctgaaatctggtttgctatcctatttctcaactccatggtaatttctctcattaaggtccctaatgcctcttttttttttttttttttttttttttatcttttttttttttttctttttttattattattattatactttaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttgctaatgcctcttaactgccagtttaaaagactgctgtttagtttcttttgtgctgttatttctgcaacatataatatttctgtgacaaatagactcagttctccttctacttcattttcattctactgctccggtgactcgctcattaaaggttgacctccccaggtgtttcatcctttgtcctttttgtacagtacacatgctccttagaaaaatctcatccaatttaaagtgtcagctatcacctggataataatgactgccacattttatcattagccctgacctcttccttgtgcttcagactacatttcctatttgcctcctgtgtccagccccaccacttgacctgggcactaccaattcccccattgtaatgtcagaatggtgcacgctgtttttgtgaagtgacatctttcggatacttggtggcttttcatatatgcacacccttgatggcctgggcagtttcacaagtgttcttaaaggaaacacaaatatttgaaactcttgatttgcctgattttgaggggttttctgggtcgagtgaatagcaaaccattttcacagatccatctccacttggatgacctgcaagaatctcaaatgtaatatatcccaacaaattgtatgatcttctccctgacatcctgcccctaacccccattccagcccccaaagtaatctcacaacatgtatgttttttcatttttaatctcagctttaatggctttgcacacttcacctattagcttaggccagaaatgttgaatcttcattcgtctttaacttccacattcaatcagtcactaaatcccgccaatttgtttttagtaacatcgccagaacctgcctactgatttactaagggcttgtactaactatcatgtagaccagtggcttgacctttttgcccataacccatggtataaaatatattttacattgtgccctgggatatagacatgtttatgtacatctgtgctctattttatttcatttcacttttctaaaattatggttatgataccctaaattgattttacaatctaccaatgggttacaatttgcagtttaaaacaccctgacctcaaataatagcactttactcgtctcccctctcccgaccccggtgggtcaatagatagcacttcagaggttgtgtaccaaaacccttaaaggcagggattgtaatctgccaaagaaaatgctcccaagaaggtgattctgatatctcctatatgttctactcagttatcaagacaatactgaatatttcttagacatgtactatacataaagcacacagctgtggctcaaataagcatggttcactgatttggcactcacatttacatgaacttggaaccctcaaaagcccttaatgctccatgtattttcacacctccattgacactgcacatactattccccttgcctggagtgtcctccatactccctttcatcaggcaaatgcccatctgtagcaatgtatacaaaaatctatttatttaccaaagacagttaggtagcagaggggtagtagtggtactgggcccagtttatgtccctctccagttactctgtttcctggtcacaatggtcccagcaaccgccatggtcattgctgccagctcactccacaaagtctgtcacaatagcctgcctgcccctcactctttgatttgctgactcagaaatactggaagtcatattcatggtttatttaaacaaggaaaaacatatgtatgagcaggatgccccacaggtgttaacaaccacatggccttctgattaagaaagtttccatccttggatactcatggttttctcctcatttctctcctacctgggaaatataatatgaggaaggcactgttaggaatccccaccttaagggtgagggaactggggcataaagagattgagtgattattgcaaggcacttaaccaatatgcagcagagcctagagtttgaaaacatctctggagatgaaaatatgttccttttctctcctataatatttaagggaaaaagactacaaatccaatttgtacttgtctatgcactggtcctgtttctcctgccttctcatgaaggggactcaagcctttgtgtgtgtgtgtgtgtgtgtgtgtgtgtgtgtgtgtgtgtgtgcacgcacgcacgtgtatctctgtgtgtgtactctcaatcagcactctaaaatatattggcactctgaaatatatgtgtatttatgcatgttttataggcacatattactgtataatatactatgtaaattataaaacaaacacacaaaaacataaattcaaaaagcatgaatttttaaaattataagagaaagttctaatatttttctgcactccccagtatattaccttggatactgtattttggagacctgccataaagtatcatacttagtagaaaaacatattttctttcatatacaggaaaaatattgatccacaatcaatattgttcacagggttgcttctcaagctgtggtgttgtctgaatgtcatatcccccaggatgccattcaagacaagcatttgcagttttgagatggctaattctaattaggaaagcagactgccaccacaggttataatctgactaatgtgttcttggaaccgcggagctactgaagttttcgggtatgacgtcagtaaggagtgatgaaaggaggactggattaacagcagataaaagttctaaataatttgacctctgcttaaaatagcgatgggccttgaacaaaacatttaatagtaacgggtcctttgattaaattgcttttgcatgtatttaatattaattccactgatatgatactaaccctaagaaataagcatggctgatactagcccttaattttatatcataaatgagcaaaatcttaaagagagtaaatgacttgcccacacagtaaaaggcataactgggcttcacaatggtatttttgactcatgtattatcttaccttgcttaacctctttgggcttcatgcctttaaaataaactttctgttttagaacagttttaggttttaaaaaaagttgtgaagatggtccaggtagttcccatatactttacacgcattttcccctatgtattcgcttgctagtgctgctgtcacaaagccccacagactgggtggcttaaacaacaacagtttattttctctcagttctggaggctataagtccaagatcaaggtgtagaccaagatcaagaggcttttctggggcatctctccttgtcttgcccatggcctccttcttgctgtgttctcacatggttttgtctctgtcctgatctcctcttcttatcaaggacaccagtcaatttggattagggcccaccccaatgacctcattttaactaaactacctctttcagggccctatttccaaatatagtcaatttttttttttttaatctgagtcttgctctgtcaccaggcgagagcgcagtggtgcaatcttggctcactgcaacctccaactccctggttcaagcaattctcctgcctcagcctcccgaatagctgggattacaggcacacaccaccatgcccagctaatttttgtatttttttagtagaaatggggtttcaccatgttgcccaggatggtctgcatctcctgacctcgtgatctccccgcctcggtctcccaaggtgctgggattacaggcgtgagttaacattcctggccccaaatatagtcactttctgaggtactggggttaggactccaatatataaatttggatggggacacaagttagcccctaacaccttattattaatgctttacattagtatatttatcacaatcaataaacaaatattgatacattattattaactgaagtccatatcttatttagatttccttcattttcacctaacaaactttttcagtcccagatgctatccaggataccacattacattttgtcactgttatgtatttaaatgtttgcgtcctctcaaaattcacgttgaagttctaaccctaatgtgatgctatctggagatggggtctttggagggaattagatttatatgaggtcatgaggattagtgtcctataagaagaggaagagaaaccagagcttgatttatactgacaccttgatcttagactatccaacctccaaaactgtaagaaacaaatatctgctgcttaagccattcagtctgtggtattttgctgtgccagtagactaagatagtcatcaggtctccctgagcaactcttgactctgacggtcttacagttttcttgtttttgatggccctgagagttttgagagtactggccagatattttgtagaatgtccctcaattgggatttgtctctttttttctcattaatagactggggttatgagttttagagaggaagaccagcaaggtgaaatgtcattctcatcacttcgtatcaagggttcatgctatccacatgtcctatcactgatgttgttgacattgatcacctggctgagatgctgtttatcaggtttctccactttctcccataatattactcttttctccttctttccatactgtattctcacttacagaatgggaagtttaggacttcacatgttatttgtaaaacagcaggactggattagtccatttctaagtcatctctagtttgttccttataatcaatgagaagtactgtcctgattgaaaaggaaatctgtattcacagaacagggtgagagagcaggatcacttaggttcaaacccttagttttaaccgtcttagcgttctttctgaacagagggactacaaaaaaccattgtgaatgtagcaatttaatgatctacttttttgcaagttggcaccatattatgtattgatcagccttggacagatcactgtgtccagactcaattctgaaaacttgtggagggttggagagtaggggtatgtctattcttcacctaacaacactgatgatgatgacactgttggtcataaagcaatactcaataattttgttgattgctgatcagttacttcaaacacaaacttgtagaccattttctttctttctttttttttttttttgagatggagtctcgctctgtcacccaggctggagtgcagtggcatgatctcggctcactgcaagctccgcttcccgggttcacgccattcttctgcctcagcctcccaattagctgggactacaggcgccccccaccacgcccggctaattttttgtatttttagtagagacggagtttcaccttgttagccaggatggtctccatctcctgacttcatgatctgcccaccttggcctcccaaagtgctgggattacaggcgtgagccactgcacctggctttgtagaccattttctagaaccaacaggtaaaatttactagagattttatcttggacgtgaactctaggtagtttacatttcttattctagcatatagtgcatgcattgagattctaccaatataaatatgtaaaataaggcaaaataaatgaatttcaaaaggaaattaaggtctttaagctttatctatgtgaattatccttaaaatgtgaagaattgctagctgttttttatccaacttcttatttcctgcaccagtttgaaacatactctccttaagaaattcttaaaagtttccaattactgtaagaataatggaaatttttctctttaaataacccgaacattaatttgttgttctttaacaggatttcctttttaatgattataaaagctcatctgtccatgatatatagcaatgtacccatacaatatgaaattgtattttacccataaacagtcttcaaacaagacacacaattttcttgcttactggctaattaaaataaaatttaaacccacattaaacttgattacattgtcaaaacacccacatttttaaaggagaggcctacagtgttaattcagagagagtgattctttactcttcagctaataatcgcttcagtattaataataacttcagctaaaaatagcttcggtagtctcagatttttaaaatcatgtcaatgtaatcatgcttttatgtcctcttcatttgtggaaaaggaaacaaatgatttgtcctatgtatgagaagatcttttaaaatgaagtttctagggtttccaagttggcaaaacgtttgtcagtatcatcatttggtttgtagaccacattgattcatatactggctacactgcatattaattgcagtttctttattatggaatatttaaaatgcacaaagatacacagtgaactataataaatacccctatgcgcccacctccaggaaaagtaatcattgtgtttttaaaaaataaaacatcatactggagttcctctttgtttcatgttcattctctttcttcctcaggagttatcagtgtgctgcagttgatgtgcattttactcttcgttttatcatatctgcccacaaccacaaatgccataggactgtgttttgtatttcaacattttatttaaactgtatcatattttctgtatcattctatagcttactttcttgactccatatgtgaattcaagagaaattaatgttgatgcatgtagtctagtttatatttttggctatctagtattttgtcatgtaaataaatcacaatttgtttatccatttcccctatgatgagctttaagttgttccacaaagttgagtcttgcaaaggttgctagactgaacatccttgtgtattcttgtgtacgtcaactgtgccagttgtggggggagaatatacctagatgaggacttgttgggttggaagacaagttaacttcaattttaccagatagttccaaattactctttggagtgattgtagcagaattcactcccgagtaaatgaaaatttctatttccaaatatcctcaccatatcctcagacattttaaatatttaccaatctgataagtattcttcttgctctcattttcctgatgactactgagattgagcatttttcatgctttttcttgtttcactttaccttctttttctgtaaattatttattgccttatctttttattgcttcataagagttctttatatatcttgggtattaatgctttggtatgcaactagtaaatatctcttcccagtttataacttgccttttaatttaactttttaaatatgtattgactaagaagttagatactagtcatttaactttatgtaattttttattctatagataatttaaatttcggaacagccatatatatgtctagtttcttttcattttgtctttcaatcagctctaataattttctcaactgagatcttgtatgagtttcatttatttttaactatattatagtttttgtttttcttttttaatgagctttttaaatttacattttctaaatgattttttgctggtatatatgagcactatggatggttgtacattaatctttatatgcaacaacattgcttaactctcttgcttttccctacaggaaaatatattaaaataaccatttttttctcccttttcaaaattaattcctattttttgtcttattgcattcattagaaaccccagtacaatgttgaatagcaacattctgtcttcttaaccttaaagacaatacttctagagtttccctattaaatatgaaatttgctatatttttggtatatggccaaaagatgtacatgtaagatgtatcagtcaatatttagatttggaggtaacagaaactcaccccaactatcttaaactgaagttgggtaaatctgattctttaggtcgctgctgagaactccattacggacatcactgcttcttggtactcagcactaattccatcatgttctcattttcatagctaccagaaaaacttctccactgttcttgtatcttactgtcgctctcttgagagtcaaaggcctagatgacagcattcaattagctggagctaggaactaacatgactgagttgggtttttcctttcttgtacgatccaggcccagttttggtgtcaagattgtactagcttcataaaatgaattgaaacacttttctttttccttcccttccttcctttcttttcttctttctttttttttctgaaattgattaagaaaaaaagtatcaggtttttgaaagtttggtaaattgtaaaaccattctggttagtgcatttttagggacagggaaaatagatagacaaaaataataatttattcagttattagttgtctgttcaggctttgctatttctattttggtcatttatattttttggatacatcagtttcttttaatttttaaaagctttgaagataaagctattcacagtattcttttaagttattttttcaaatttgtacagtatttatagttgtcgcttctttttcattcccagtacaattatgtatcgtgctttctcttttcttttgcttgaccaattttgctacatgtttatctattttattagttttttcaaaccagtttttatactagttcatcaggttctaaaaattatgctgcaatacttatggcctaaaaggaatagtaattataatttttagtcatatgtagtaactactaggaaaaactttatttttctgttttaattacattaaaaagtcccctggaaaatatgagttaagtgttttctcctgcggagattgcagtgagccgagatcgcgccactgcactccagactggcgacagagggagactctgtctcaaaataaataaataaataaataaataaaagctttttcctatctagtttttacaaggaaaatcttttttatttatttattgattgatttgttatcataatactttaagttttagggcacatgtgcacaatgtgcaggttagttacatatgtatacatgtgccatgctgctgcgctgcacccactaactcgtcatctagcattaggtatatctcccaatgctatccctcccccttccccccaccccacaacagtccccagagtgtgatgttccccttcctgtgtccatatgttctcattgttcaattcccacctatgagtgagaatatgcggtgtttggttttttgttcttgcgatagtttactaagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaataatgccgcaataaacatacgtgtgcatgtgtctttatagcagcgtgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccaggacttgttgtttcctgactttttaatgattgccattctaactggtgtgagatggtatctcattgtggttttgatttgcatttctctggtggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgactaggttgcgaaaattttctcccattttgtaggttgcctgttcactctgatggtagtttcttttgctgtgcagaagttctttagtttaattagatcccatttgtcaattttggcttttgttgctattgcttttggtgttttagacatgaagtccttgcccatgcctatgtcctgaatggtagtgcctaggttttcttctagggtttttatggttttaggtctaacgtttaagtctttaatccatcttgaattgatttttgtataaggtgtaaggaagggatccagtttcagctttctacatatggctagcccgttttcccagcaccatttattaaatagggaatcctttcctcattgcttgtttttctcaggtttgtcaaagatcagatagttgtagatatgcggcgttatttctgagggctctgttctgttccattgatctatgtctctgttttggtgccagtaccatgctgttttggttactgtagccttgtagtatagtttgaagtcaggtagtgtgatgcctccagctttgttcttttggcttaggattgacttggcaatacaaggaaagtcttaacagatgtacacaatttttgagacatataagtaggttttttctccaataaacagatgtttataaaggatttgtacgtgccattatgataaactacaaagataaatacacatgctctgttctctaagagttttccagccaataaaaatttacagctactctttattgtccaccatactctgttatgagccatgggctttagtaagttctcatgacattgggcactgacttcctgggagtgtaagtgactcacctggaccccacagccagtgagcattagtgcttatattccatcctccaaagctctttcttcataccagaccacacatgtggcccaaggagggatatttactctgcacttttagagttctagaaaacattgtttagtggtctggcatcatctatatttacttggcttgatttgggatagagtataatcctagtcctcgatgaaaggattttgatgagttaaccttatggggtgatgggatttatgggattatttccacacttaaaatgatttgtgggaaaaaaaagtgtactaatccctaatttaggattaagacagatatacctatgagatatgggtctataaaattcatcataatttgagaaatgcaacaaataatcacctctaaaatatcttgttggttcagttattttagtccaaaagccagttggagatctgttctgtatcaagggctccagccctcttgtgagaggtagctgtttttcattcgcttgtagtcttgaagtaaaaacaatgtcagggacggtctcctcagaaccccagagggtctgccttttaggaagtgtttgtcccctcagaaacgagaaaccagatgagctgagtttaggggtcagaccagaggaaatggctggaaattagaggtctcctggctaattcacatgatgccaaataacagtctttctgttgggtgtcagaatccagaatggtgggaaatttgtatctaggggatataaaagaaaatgaatgagataatatatgcaaacagatgagtagagtgcctgaaatgtactaatagccttcagtagattccttctccaatttcaccccttctccatctcaggtttggctttcccctggacctgtcaataaaaaccctgagagtttgattgaacaatggcactgtatggtcaatgctaccagactctttaacatgccttgtttgccacaatttcattgaatgggagcagaatggcaaccaaaccaaggctaacagactttgtcctagaattcccacaccaagtaggaagcataaaataacttagagacttgactatagttcctgcagctattagtcatggtgtgttagcagaacacaatctcagaaagttatttcctaaatgccttccaaagccttggttcttcatgcagatagttttggccaactgtaatggcagtgagaaacttcacgagtgtccagaagaacagaatttatactttaagtttaactttgttttggattgaatgttccttaaaaataaaccttcacctgattcttattttcatttcaattccatgggctggtgatttgagtgtcagggatagagttcttagaatctgtttatgtggtgtgaatacagaaatggtctgattctgagtattaggatcatgatcagagttttgatataaactcaaaacctcactaagccacatgttattttttgaagcatagaaattggactttgcaaacaaccaaaatccttttgtttgagaaactctaaataagcattgagttttcttgccatgaagttttacactgtatctagaaagtttctttgaaaaattcctctgtaaacctaaggctgacaaagaagttggctagttgaagggaaaatgatacttatgttttgtggcaagggggaacaaaaggagggggaaaagtaattactgtccacttaacattttatattaaatttctaatgcataattttcaagacgggcaagagttttggtttgttttaaccaaatatagttacaatattaaatacgtgttctaaatccagcatgtgaatatcacttcttcaaaaaatttttaattttttaaattgaaaaataaatatatgtatttatggtgtacaacgtgatgctttgaaatatgtatatatcgtagaatagctaaatgatgctaatttacatatgcattaccttacatattcatcatttttttgtggtgagagcacttaaaatctgctgccttagaaatttacaagtacacaatgttattaactacagttaccatgttgtacaatagatatcttaaacttattcctcctgtctaaccgaaattttgtatcctttcaccaacatttccccaacccctcatccccccactcctcaccagtaaccatcattctactctctgcttctgtagttcaatttttttagattctacatataagtgagatcatgcggtatttgtctttgtgtacctggccaatttcacttaacataacgtcctctagtttcatccatgttgttgcaaatgacaggatttctttcttttttaagactgagtagtattctattgtgtatatgtgccacttaaaaaaaatccattcatgtgtagatggacactttggctgattccaaatcttgactattgtgaataatgctgcaatgaacatgggaatgcagatatctctttgacatactgatttcatttctttgaatatatgcccataagagggattgctgaatcatatggtggctctatttttaagtttttcaggggcttccatgctgctttccacagtggctgtaccaatttgcaatcctaccaacagtccacaagtgatccattttctccacaccttcaccaacatttatctcgtctttgtgttgataaccatcctaacagatgtgaggtgatctctcactacggttttgatttgtgtttccctgttgattaatgatgttgagcatttttaaatgtttctgttggctatttgtatttctgtatgtcttcttttgaggagtgtttccaggtcctttgaccatttttaatgggttatttgttttcttgctattgagttgagtttcttatatatactggatattagcccctcaccagatatatagttcacaaatattttctccttgtccatgagctgccttttcattgtgttgtttcccttgctatgcagaagctttttaatttgatgtaattccaccttttgtttgcttccttttattgcctgtgctttgggggtcatatctaaaatatcattaatgagcagcttttccccattgttttcttcaagatcaatgtcaaagaggttttcctttctgttttcttctagtttgaggacttatgtttggatttttaatccattttgagttgatttttgtgtctagtataggggtctagtttcattttttggtatgtggatatacagttttcctaacaccacttattgaaaagactatcaatttattaaagaaaagttttgatttgttttatccaaacacagttacaatgttagatgtgtgttggaaaccagcatgtgaatgtcacctcaacaaattttaacaacagaaggaatgggaacagcaaggggatgaggaaataaacagaacataggatttaacaatcaatgggatattaacacatttatgcctgaggttgcaattttttgcatttttgcaatcagaccttgcaatgaccttgagcagtaagatataataactcccatgcttagcgttccaataatggaacactaggcataaatgggtttaagggcacttggggtcacagatgtaagcttagaaggggattaaatgtggccaatgccttgcttttgcccatttaaaaaatttcaactaattctgatgttgttctaacattctgtgattacaggatggtaagtttgcatggtggaagatcagattgggcaccaggataatggccacagggacctcagtagagctcccagtaactcaagggcaccaggagtatgtaaggagtggagagagtgcacaaagaaaaacttgacccacttcataatttaagctaatgtcaatccgcctggcacttcagagtcttatttctcaaaacgtggccccagaacagctggtacccaaatgccctgtgggtctgttaaaaatttaagttcccagaagacactctaaaccagtggaatcagaacactgggaatggggtctgagaagatacattccaaacaaatagcctaggcaattcttaggtactctcgtgattgaacctctgcaccaaagagggaaaagtataagttagaaaggaatttataagcaccatacacaaaaatagccatgactcaggcctccacatctcatttgtgctgtcacttcccctgggaagcctgatcaccccaaatgccgcattgtataatcttttttttttttttttttgaaatggagtgtcactctgtcgcccaggctggagtacaatgacatgatctcggctcattgcaagctccgcctcctgggttaaagtgattctcctgcctcagcctcctgagtagctgggattacaggtacctaccaccacacctggccaattttttgtattgttagtagagatgaggtttcatcatgttggccaggctggtctcgaactcctgacctcaaatgatccacctacctcggcatcccaaagtgcaggaattacaatagtacctaacatactctattgaattgctggcttttctttctctttagcccatgtaatccagtgtcattcatctcctctgcttaacaaagagcttagttcatgaaagccgcccaataaatgttctttaaattaataaatgacttcatgtcttgctgttccaaaatatactccttaacctgcctgaatactttcacttcactttgccaattatttcatttggtatatctgagaattttagtttaaataatgaaatcagtcagttatccagtagggtcaattaattccactttcgctttcccaaagattgtagagcaaccacacacagcgaatgaggaagcagtgatgcaagtaattttgaaacacagttttagagttaaattgtttctggatgcaggcatacaataaatgggtaagtgctgtgtgggggacactgagcaccgaagagttggagggaaagccccagggagttatgaaagggagtacagggaacagggaagaaaaggaagatgtaacctacttatctaaaacttttacctagaaatgaacctgcattcagggtcatggtgggagaaaacactcctcctcctttgatggctgtgacctcctcatagttcctgaacatagcactcaagctggtcctaatcccactacatgaataagtgaaataggctttgagaaactagtctgaaaagttggtcaccctatgaaaaaatgcatgcaaaatcccagaaaacatttcaaaacttttgaaatctaaccaactcagaaattgagcaaagccaagattagatgtgtcttgcagatcaacttagtgaaagcagatgttactcgtgaagacaaaggtcaggaccctagagacataacaagaaatattttatgagaaggaaacttgatgtggattgaaaggcagaagaaatgaaaagaaaaaggcacatgaacatttttaagcaattgtaacagaatgaccaaattgcctgaaccccagacatatgataaatcatataacatgaataggcccccttcaaattggtggcatgcaacatggcaaaacccatctctactaaaaatacaaaaatcagctgggcttggtggcgggcacctgtagtcccaactactcaggaggcagagacaggagaatcgcttgaacccaggaggcagaggttgcagtgagccaagatcatgtcactgcacttcagcctgggtgacacagcaagactttatctcaaaaaaaaaaaaaaatggttgcatgagcaattatagtgatggtgactccagttttgccaagatataagcaagattgaacaggccagaaaatgtggatatgttagtgcaagcaaatcatcaattctttttttttttttttttttgtatttaagttctgaggtacatgtgcagaatgtggaggtttgttacataggtatacatgtgccatggctgtttgctgcacccatcaacccgtcatctacattaggtatttctcctaatgctatccctcccctagcctcccaccccccaacaggccccggtgtgtgatgttcccctccctgtgtccatgtgttcttattgttcaactcccacttacgagtgagaacatgcagtgtttggttttctgttctggtgttagtttgctgagaatgatggtttccagcttcacccatgtccccacaaaggacatgaactcatccttttttatggatgcatagtattctatagtgtatgtgcgccacattttctttattcagtctatcattgatgggcatttgggttggttccaagtctttactcttgtgaacagtgctgcaataaacatacatgtgcatgtgtctttatagtagaatgacttataatcctttgggtatatacccagtaatgggattgctgggtcaaatggtatttctagttctagatccttgaggaatcgccacactgtcttccacaatggttgaactaatttacactcctaccaacagtgtaaaacaaaacaacatatatttattaaacatatgtgtctctgtctgtgtgtgttacacttaggcacataaaagatatttaacaaacattgttgaatggataaatgactgaatgagcagctactatgtgtcaggtgctagaaatagccaaaatgttctaaaagactgtggggaattagcaattccttttagaacaggagtccccaaccctggggccatgaaccagtacctgtccgtggtctgttagaaaccaggccacatagaggaagtgagtggcaggtgagtgagcaaagcttcatctgtattttacagctgctccccatccctcacattaccacctgagctctgcctcctgtcagatcagcagtggcattagattcttataggaaagtgaaccctattgtgaactgcacatgcgagggacctagactgcgtgttccttaagagaatctaatgcctgatgacctgaggtggaactgaggcagcgatgctagcactcagcagcagctgcaaatacaggttaacatcagcagagaggcttgactgcatagaaaccataataaatcaattgcttgcagactcatatcaaaaccctaaaagtgagtgacatgtgacaagtaagctgcatctggtggcaagctttatagtggcaagtgagttgatgtacttcaattgtacagctgtatctggtatccttaaaagtatgtttcagacaatttcaaatctccatatgttctggattgaagtcaaggcagaatatcctgagattgctacaaaagctctgaaaagcctgcttccatttccaacatcctatctttgtgaagcagggttttctgcagtgacagcaaccaaaatgagattacagagtagactggacataagcaacacactttgggtgtcactgtctcccatcacccacagatgggaccatctagttgcaggaaaacaagctcggggctcccactgactccacattatggtgagttgcataattatttcattatatattaccatgtaataataatagaaataacatgcacaatacatgtaatatgcttgattcatcccagaaccatgcccccgaccctgccagtctatggaaaaattgtcttccatgaaactggtccctggtaccaaaaaggttgggaaccgctgctctagaatgtcccccttggctgaggagtccctgatcaaccactgaggctctgcttaagtgttccctcccctgcaaagtctactatcaccctaattaattactattccactgaaaagctcatcccaccatcttacactggttagatgttttacctgcttgtcttcattactaggataaggggaaaaaagattctgggtttgttccatatttgttttccccaaatctactgtttgtaatagggaaagggagaaaggaaaggcataagaaagagaagagaggacagtaggcagggaaagaaggagagcaaggtgaagtaaatcatgttcttttgcccctaaggaaattatgttacatggtaggtttgttgttagatactgagaccctgattctaccttatattcaatggacattgtttaattgcatttattgctttaccactctggaaagaaatgtattaatttaaaatgttttggatcaattatttctttttattacagttcttacggcttattgaaaccactcagcacacttttaaatatgtaaaatgtatgatctgagtcatgataaaaaagaaatttcataggtaacagcatcagtaaatatgtggctgcactttcagtgctgacctacctatattcttttctgagtttacaacctcagttatcaacaactgacattactcaatagttggcacatggcatccaatgcatggacttgaaagtaggcttttaaaattacagtaatcggccgcgtgcggtggctcacgcctgtaatcccagcactttgggaggcggaagtgggcagatcacgaggtcaggagatcaaaaccatcctggctaacatggtgaaaccccgtctctactaaaaatacaaaaaaaaaaaaaaaaagccaggcgtggtggtgggtgcctgtagtcccagctacttgggaggctgaggcaagagaatggcgtgaacacgagaggcggagcttgcagtgagccgagatagtgccactgcactccagcctgggcaacagagcgagactccgtctcaaaaacaaaaacaaaacaaacaacaaaaaaattacagtaattactgtgggcatgataattgtatgtgtcaacttgtgttgtgtgccacagtgtttccagatatttggtcaaagagttttctggctgtggctgagggggtgtcttcgatgagattaacatttgcatcagcagactgagtgctatgatttgaatgtttgtgtcctcctctccccagaattcatttattgaaactaacccttaatatggtggtattaagatgtggggtgtttggggccgggcacggtggctcacacctgtaataccagcactttgggaggctgaggcaggtggattacaaggtcaggagatcgagaccatcctggccaacatggtgaaaccccatctctactaaaaatacaaaaattagccgggcatggtggcacatacctgtagtcccagctacttgggaggctgaggcacaagaatcgcttgaacccgggaggcagaggttgcagggagccaagatcatgccactgcactccagcccgggcgacaaagcgagacttcatctcaaaagaacaaaaaaaaagatgtggggcgtttgggaggtgattgggtcatgaaggtggagcgctcattaatgagcttattaaggagattactgcccttagaaaagagcccaagaagtctatgtgctccttctgccatctaaggacacagctagaaggcaccaaagagcaagtccccaccagacactcagtttgctgtgtgcatgtggagatctcttggtgccttgatcttgggcttcccagtttctagaaggtgagaaataaatttctattgtccataaattactcagtttaacatattctgttatagcagcccaatggcctaagacactgagtaaagcagattgacctgaataggctataaatggaaaggaaaactcttcctgcctgactgcttgatctgggacatcagtctttatctgtcttctgactcaaactaaaacatcagccctttggggagtctcaagcctactggcttgagataaggggaaagacccacccccatgattcaattaccttccactgagtccctcccacagcacatgggaattcaagataaatttgggtggggacacagccaaaccacatcatcagggttttcttacatagtgttgataatcctttccagggtactgggtgtaatgagccttaaaggtctttaggaccctgatgtaaagactaaattaaagatgtgtgtttgggggcaagtagaccacttcagcacctccagtgttgaactcatggagttctgggtggccaggggcattgttcaatatcaaaagaaccttaaatggcagtcccttactggcaaggtacctcctgacttgagggacaaagcataaatggagtcaatccagaaaaagagttctcattgtacaggccttcttgtacaaccaaaagattggcaggtggtgtttaacttttcccttcaaggctcaggggttagctgctttatagataagggcagtccttatcataaaccgaactgcatttgcacaaaacagtagaggtagcccatctcttcctgccttaaatcctggtgctgacttctttttcttactaataaatgtccttcatggcatttttttgcagaacagggcacctttatttgcattaaaaacctatttagtacacctactatgtaccccctaaaattttaaaaaattaaaatctatttaggcagatattcttctcagtgattgtcttaatggtgcctgggaactcatctgctgcctattggttggcaaaacctgattctcctgttatcgtcacatttttaaaaccaaacatctttctaaaactatcacaccatcttttgctggcattaaattcttcagctttagttcctttaacttccttttactttaagttgttatatgacttcactttttttcaaataataatagagtatttaggcatggtttttttttgtttgtttgtttgtttgttttagatggagtcttgctctgtcaccagtctggagtgcagtggcgcaatctcggctcactgcaacctccaccttccgggttcaagcgattcttctgcctcagcctcccgagtagctgggactacaggtgcacgccaccatgcctggctaattttttgtattttagtagagacagggtttcaccattttggccaggatggtctcgatctcctgacctcatgatctgcccaccttggcctcccaaagtgctgggattacaggcttgggccaccgtgcctggccaggtatgcctttcttatagcaattctgcaccgacataaaagctccattttcaatatgagataaaaaggtattttgcaaaaagtataagtttttatacctgctggtgtagctgcagtgacagcctcatgaattttctttcttttttaacaatgggccttgcactagattcatttatcttgaaatggcaggcaatcgcagctgcagacctccatctatggtaaacatcaagcagttcaactttttcctgtcatgatttttctctgcttcttgggagcactttcagcaacactaatggcactttgtatagatcccatggtgttattcaaggtttacagtattgcactaaatataatgaaaaatatgtgagaacagtgagaggtcactttttactgtcatatggaatttactggagacacaaactgcttatacagagataattagtgacatgaaattttaagcagatacttgcaacacctgagcttagcacaaaagcaacaggagctggctatgacatttttgcagtaatacagtatgtacagttaattgtatgcagtaatgatttaatactttatgtttgctcacatttctcttgactgtgaatggtacatgtgcagtctgtatttgggtttgaaagttttgagaaattttaactttttataatagatttgtatgtattttatcataatgtatgataaaacagatgagtatatccctagcttttttcttaatttctttttatatttccaggccatatggttcaactgcaagtttttaaaaattgttgcaaatctccaaaaaaggattcaatatgtttattttttaaaattgtatataattaaacttgcagttcaaagatagacttgaaccctaattattccaatggataaatcagtataaatatgtagttattttttttttaacatgagaagagatgggaagttggttttggacaaatctgaagctgtttctatgatattctataatattggtttgtttccttgatatttatgtatctttcacataaaaataaaatataatagacaatacattaaactgggagcccagaaactttggttctaggattgaattatatgtgagacattcaataaatcactgaaccttctaggcttgagttccctcactttgaaagtgaaaggatgaaatatttagtttcaggatactaaagacatcttgatccctaaactgctttctggaaaaaagccaaaagcaacaaggaaatttagcagtacacactcccatctgtcattattagaaaatcttcattaacttcaaccataatatatatgaagaaaggctggcaagtatagtgaatttggaccagagagaggcaagaaactgaaagaagatggttactggacctcaaaggatgacagtgcagaggtctttgaagtaagtgatacacatcaaggggtaagacatgatagaacaagatggatggcctcaaggagctcctgaaaccccacaagaaacccctccaatgcaggggatgtgatgacaaatgaagacacatgcagacaagctaactctacaagaaactatctgtttggaagaccagatgagaaactgaatgataagcagcttgaggctgtcaatctttatccgccattgaatgtaaactccagggaggcagaaattttttttctgatttatctattgctgtattctccaaacctagagcagtacctggcacaaagcaggtgcacaataaatatttgtatgatggatggatgagtaaagaaagattacagctaaaccacacaatcgacatacttgtgtgtatgtgtgtgtgtatatgcacacgcatgcaaacatgcaaacattaccctgtcacctctagagaaaaatcccttcattattgaaaaggaattaacataggatttatgcaaaaataaccctatttacataaagaagcaaggcaacaaaacaaataaaaatcataaaaagggcaaccaccaaaaatatttttattgccctagagaaggtaaaacttgtgaccaaagttatctgtgagttcataaaacttaatgaataaggtgacctttctgtgttaggactccagagtgaagataagaagtctcaaatttaaaaaaagataaggcaataaaaaatgttaaaaaaggtatttggtagatcttgggatagaagtaaaagagcaaaataaaaacatcaaagaaataaaagctttgggccaggcacagtggctcacacctgtaatcccagcactttggaaggtagaggcaggcagatcacctgaggtcaggagttcaagaccagcctggccaacacagtgaaacctcgtctctactaaaaatacaaaaattagctgggtgtggtggcgggcacctataatcccagctatttgggaggctgaggcaggggaatcacttgaacctgggaggcggaggttgcagtgagccaagatcacgccactgcactccagcctgggcaacaagagtgaaactccatctcaaaaaaaaaaaaaaaagaaaggccttaatgggaacagcaatgttgcccatgttgaaaatataagtgaagacattcatgacatcttgagaaagtggagcaaaatgaaatagaaaagaaaaaagactagagtaggaaaaaattgtagatcgagaacacaggggaaattgacaggtacaacacattggatttttattagaaattatatgtaaaacattcaatattcttgtttttaaagacaaaatcagaaaaaaatggagaacaaaaatatccaaagttatatcaaaaaactcctgaaataagagatttgaatctgtagaattaaaggacacacaatattccagcaaacataaatatctattaatttccatgcataatctagtaaagttaaggaacttcaaagaaaaataaagaacccaagagtatctaaaaaaggtgagggcataaatatcttatctgaaaagcaaaagaataaagctagcttcaaatttctctccattcagtgctaggaataatgaaatcatcaagttctcagggtaacaaagtatgacccctaaattatatacccagacacaccaggcttgtttcttctgtccatctgtgcaataactttttcaaatgtgtaaaacgtaggggaaaaaaacctacatgagctttaaaaaagctgttagccaactaggtcaaccaagatataaatgatgagctatgagcattaagtcattttaaatttaaaactaaggttaaaatgacttcaggaaattagggtgtgcagaacagaatagaaatgtaataagttatccctttataaaaataatataactaacaaaaatcaggagcgagagggaaatgaaaatgggagataatttaagtaccaatcttctcatttttaaatatattgtttaaggctgatctgagactaaggctgatctaagattaagcacataactaaccaaaatgagtgtagcagaaaagaaaagcaagaagatggaagtaactggacatattctaaaagcatcattcatagtgagaaattaataggtactgtttaaaggaagagagaccttacgatacataaagttatatcttacaaagtaacaaattactagaggaactcaagtagatcataagcctttcatattatgaaaaattgaccttagaaatcacagaccaatggtaaaatattaaaaacaaagtgtaatgaacttatccttccaggaatgctggtttacatcacataaaccactcctggtaagaaaaattagcaaagcaggattcaaaaaaatttaatcgcaaaatagtaaacaattatgaaacaaagaggagaaaaagggaaatcagagaggtaaatcctaggaacgtgattcaaggaatagttgagcagaggtttggcagcactatagggctagacagtaagaaaaaaaaatctatcaagaaaggatctctgataaaccccctacattgagttgggatcccaaagggctccatctagtagtaaggggtagctggaaaaaaaacttgggacagaagtccagttttcaaccatcttagttcctctaattggattacggtaatataagattgctagttcccctaaccaactgccatgagcaaatggaaatcctaccaggaaatacaattttaggcttcaaatgatttcaacactttttgtatacaacatcttgcacacaataaaaagtaaccagacaaatgagaagagaagatgatgtaataaaaaattgagagaaataccagcaacagaaatgaatgcacaggagattcagaatatgaataatcagacattttacaatttttaatagagaaaatttttttaaacccaaaatggattctttgaaaagactaataaaattgataaacctttggtaaggttgattgaggaaataaagaatcagaaataaaaaaggagtctattatcacagagcctatagatatttttaaattatattatttaaatatattaactttatgtctctaaatttgaaatttttaataaaatggatatatttctataaaaaacaatttaccaaaactgacatatgaagaaatagaaaatatgaatcattctgtaacctttaaaagaattaaaaaccataacaaaggccatcatgatttccccagagttatttaactcccttttcccatgtaaaatttacttccaaatctttgagaaggcattccttacttcagcaataggaatcttcagggttttttttaattatgaggacatattttcccttcctcatcttatttaactcagtgttataaaactgttctatgatttacttttgaggattatatatattagcttctcatatatttcataccctaggagtttagatcatatagcatgatagtgaagggagaaagggagaaaagtgggagacatggaaggggagcgaaaagagagctgtcctgatttggattgttacagttccatatctgcacccccagcagtttatttatgatggagagaaaataagtaaaaatatatgtgacttgattttcagtttgaaaatgtgttaatgagaaaaaaacccaaatcaatctaattctttatgcttactttatggaaataaaaaatttctgtactatgtggtagaaatgagtgtgtgccattctgggaaactgttcttcagaccacctggtgacctatcagttaatcaaagcatttgacattttttctaaagaaaagagggtgaaataataacttggcctttcttaaaaaaatatacccatggattctgtatccttgccagttgtctattacatagtttgttgagactgcccaacgttgtctggaatttccaagcctcagcgctataaaaataattcactagaactgcctcaaaataatttatattgtgtaattacttaacactgcactttggactacagtatgggatggatatgctaggaattatgctgggttcagtgagagttctgcacaaaggcctcttttgccgtaactaccaggttcttgatgtttaaggaattgtgttgataggccctagaaacttaggacctacaattactggagcatatttattgcagcacagaagagagttgatggtggctgatacaatattggtataaacaaggtcactagtgttccagtatgaacattcaagagcccttagggaaaacaaagaagtcactttcacaaagaactttcaattgcctgctctctgatactaaaacagaatttaaaaatgaacctagttcattttttttcttgtctcttggcgaaaagaccacagaaaactgatccttcacttaatttcaagcaaaaattgtattgtttttggtgaaatccattttttacctcaaggattcagcctaaggttatcacatcaaaatatattttctttaaaaatctgaagtttggccttgaattttaaaggaaattctgcttgaattattatataggatgaaatatttaagtattaatctttttttctctctttcaatgaattaagacaaatacaagcaccttttaaaaatcaggcagggaaataaatgctaattaaattctcttaccagtagtttttcattttgtgaaacaaacttttctagatcggatagactttactgacgagtgtttttgataatgctgaatggaattgagtatgacctcccagatacagatgcatttggacttctcatccacttagtctttttcattcaaactggaaaatcatgtggtttcatttttattatttttttaattgagaggattgtcaggagaaaatatgtatgtggctttatttttattttaaccaataagattgtcagtaggaaatgcattctgaatatagcacacatggggcaaatgttcctttttggtcatgacattttttcattataatggaggtttgccagggcatataccatgttttaatgccttttacatataaaatcacaacaagataagactttagacctctctgtaaaagctgcggtataatgggaactagcatgctctgactggttgcctcaattaataaaacagtcaggaaatctcgagggtttccttccacagatttgagtatcccttgatgacctgcataaaccctagttcttataaatctgttcactctcctgcaccggaggaaggggagatggaaagctggcctgttggtgacatacacagcattatgcttagaaaagtatgggtttcttccatgctaccatcctactcttggcatgaaattatactttgtgatcctacagtcatacatatgaaggaactacacacataggagacagcgtgaccctaggctctgactgggtatctttgtttatattttgataaagaagtttatggaaaaagttatttttaattgaacaataatttgaggcatggtaaaaaaaatatgtattgtctaggaattattatttaatatttagaaaaaaacatgaggctttaacttgaagaaataaatatattttcagggaaaatctatgttgtttcttatttatttgcactttggtactctagaacaccattaggatgtcttgtttcagattttaaaggtaggtattatccctgtgatccttcgtgtgcaaactagcttagcaacctgcgcccaggagagtaaccacagaggcagtggatctatcccatgctcccttgcatgaaccagcctggcactttgcccacagggaagcagcgccagaaccagcaaactagccacacaaactctagcagcctaggtcacagaggcacttacaggcatcactgacattgactatagaaacttcagagaggctacactactgtcctcacccagaaccaaagccaatgcactctacccaactgactccctaggacacaccttcaggtgaaagtcttcccctctggaagctactgtataaaactggaagaggcaattcttccaccagatgcataggtatcaacagagggacacaagaaacacgacactgccaaataagcacagtgattccccagttacttaacacaaagaaatagaaatttatgaatcttaaggaaactcagatacaagagaacatagatagacatttcaaatacattgggaagataatttatgatctgtatgagaaattgaacaaagagatagatatcattaaaaagaaccaaacaaacttccacttgagcagcctgagacatccatgggtgggggtattttctccctcaactgttcctaccacaggcttcctgaggtttttcctagtgaggccaagagggtctttgaggaaaactgcatccagacatgccttgagggaaggtgtcaaatgcaggagcatggaaaagagttacaatttggatatgaaaccatttttctagcccaccttagagaagactgttgacacactggtcaaaatggttccaatcgcctaccttgcaagacacttcaggttcaaagaatttcccttgtaaaagcaacaagggagttgtcagagttttccatttagatcaacaaattcaagttcttaccatggaaaattcagagaagactgtagtggttctccttgcttgtggctccttcaatcctgtcaccaacatgcacctcaggttgtttgaactagccaaggactgcatgaattgaacaggaagatagagagttgtcgaaggcataatctctcctgttggtgatgcatacaagaagaagggactcatgcctgcccatcaccaggtcatcatggcagaacttgccaccaagaattccaaattggtggaagttgatacatggaaaaattttcagaaggagtggatagaggctgttaagatgctaagatactatcaagataaactggaggctagtgactgtgatcaacagcagaactcacctacactagaaaggcctggacgaaagaggaattccatgagctgaacaaagacaagcttctagtcaaaagagatccctagagccaaaaacaaaaggtgcaccaaaagtcaagctgctgtgtggggcagatttactggagtcctttggtgttcccaatttctggaagagtgaagacatcacccaaatcatggcagactatgggctcatatgcattactcaagctggaaatgctgctcagaaattcatctatgaatctgatgtgctatggaaacactggagcaacattcatgtggtgaatgaatggatcactaatgatatctcatccacaaaaatctgaagagccctcagaaggggccagagcatccactacttggtactagatcttgtccaagaatacatcgaaaagcataatttgtacagctccaagagtgaagacactccgagagtgaagacagtgaagacagctccgaaagtgaatgacaggggccatcctggccactttacagagaaacactgcagaagctaaggcatagaaattctgcagcatgatgttttgcactttcctttcagggtttgaaacaatctgggtgttaataactgggaaaagaaattgtggtcctgttgcataaactaaagattaaaagtttagtaaaaatcagtggtaagttaaaatcagggtttttttttttttctttttatcagaagttgctaagatgaatgttttccatatggtctttttctaaaaaaaaaaaaaaaatgtacaattctctttatctttaaaccaagagcttagcagcacacaaaaaccagaagaattttcagtgaaactagctacaaataagaaatcaaaaagtacagcctagctctaccacataaaagaagcaaagtgtgaaaagcaaaagttcacttaaaattctaatttaggttatgaagagaattgacattttatgcatgcctgctgtgggtaatctgcagctagggtagacaaaggaaggaattcttatagtggtgatcttgtaaaatgcaccattgataaatcatctccagttatgcaaaataaaggttgtgcatatgcctggcagaaacattgtaccaatagttagttctctgtggcacacatcacaattgctgactaaagtttggcaagacctatcggcctggagcttcctctttagaagtaggaagtgaagtccaagccctcatatgtttagaaaagtatgcaagttttctgatgcctaccagaggtagagacctgctgccttatactttatacacagttacttttccttgttatgggtcatgctctagccttggtcatccaccctctctttatcttcagaaacaatttcagagttgacatcatgttaccttgaagtgagagaaccacagagaatgagaagtctattcaaggattttatgtctgaatgctcttagcctttattgatagcttaatcagaagatctaagtggggtgcagtggcacatgctctgtagtcccatctacctgagaggctggagcagaaggatcgcttgagcccaggagtttgacaccagcctgggcaaaatagtgagaactcattttttaaaactgtgaagtttctgaagggccctgctgtttctgttccagccaactgtgaatctgccatttgtgaatttaagcagaaaaagggtctgttttctcatatttttttcttcttgcccttttgtatgaagtttaacctaaagtagtattctcaaataattagtcatagcttcatgttaaaaacacatgcttgttacatggttttccactgattaaaattttgtggaaatttcaccaattgctaaagcagaaagaccagaaatagctttttatagaatcgttttggggtttgcgaaaattgtcctatgacagaaacaggactaaagttaaatttctaatgaaaacataataatttgcctttttgcaatttctatttcattcctacacaaacccagatgaagggtttgtaactccagaagaaaaaaaatacttagatatgtgcaattgtatagtcagatctgaatctacagtttaaaaaataaaaatgttaaataaagttaagcaaacatatgtgcttcagctcccaacttactcttactaaagccttcgggccaattcccaaaaaacagggagggtgcaaagcctgacacctagcagctttcaggatccatctgccaagtgaatgaaaggttggaatctcaaatcctacagataagagtcatttttctcctcctcagcttcttggagtttaagagttgaagcggccctgaaaagtaatgattgagcatgaagaagctataagaattgaactttgataccttctgggaaataatacacagtttatctgaagtgttgtgtaaactgcagaaaggttccaatgctagaaaattctctcatactgtcatgccttcccacttagaagtgcccatgccctgctcagctgtgactctactgacctcaggacctcactggacaagtcatgtggtaacccttgcaggagacctgataatggtgaaatgattctattgttatattatttatggagcaacaactttgtacagagaacgagctgcttggctttttcttccaatgccgaggatgctgctgatgctgccatgtaacagcatacttttgggtgtcctcaaggatagaacttcccctctgaataatggaaattagaacaatgaacttcacaggggaataaatattaattactgatgtgaagaaaatattccattgtttattccctaccacatcatttccataattggctgttgtactgtgaatttagaggaaatgggtaatgcttgtgttttgttttgcttctttgtttgatgctgggggttttatgtgttgtacactttaccccttacattgcataatttgaatgcagcaaacaaacccgcaataaaagtcatttattggcatcttcattcagatgaatggagagcctttgtggtagtgtcaaaaaaaataaaaataaataaaaataaaaagaaccaaacagaaattttggagctgaaaaatttaaccaataaaatgaagaaatacaattcagagcttcaatagcagactaaattaagcagaagacaaaaatttgtgaacttaaagacaggtcttttcaaataacctagtcagagatccaaaagaaaaaagaataaaaagaacaaccaaggccagctggacttctgggacaccaactaagcaaacaaatatttgcattatgggatttccataggacaaagatgaagagagacacagaaaggttacttaaaaaaacaacagttaaaaacttcccacgtctttggagagatatgtacatccagctccatgaagcacaaaggatcccaaacagattcaacccaaagaggttctctccaaagcacattttaatcaaatcatcaaaagttaaagacagaattccaaaagcagtgagagaagagaatcaagttacatataagggaatccccactagactatcagcagatttctcaacaaaaactgcaggccaagaaagaaccagataataaatttgaagtgcttaaagaggtgaggtgggggtgcgggggaactgtctacctagaatactacacccagaaaatttatacttcagaaatgaaggagaaatagtgtttctaggcaagagaaagctgaggtaatccatcactgctagaccagccatataagaaatgctagagagaatgcttcaactggatgtattaggaaaataattactagtatgaaaaaaagaaagtataatctcattggtaggagtaaatttattatcaaatttagaatactccattactgtagtggtggtatataaactttcagttgtctagtttgaagattaaaagtcaaaatggtcaatgattactatagctacaacaagttgttaaaatacgtacaggatatgaaaggatacaaagtaagcaacaaagttataaatttggtgggggaggccaggtgcagtagctcatgcctgtaatcccaacactttgggaggccgaggtgggtggatcacctgaggtcagaagtttgagaccagcctggccaaaatggtgaaaccccatctctactaaaaatacaaaaattagctgggtgtggtggtgtgtgcctgcagtcccaggtactcaggaggctgaggcaggagaattgcttgaacccgggagacgaggttgcagtgagccaagattgcaccattgtactctagcccaggcaacaaagcaagactcagtctcaaaaaaaaaatgtttttaataaaaaataaacaaatttgggaggtagaaggtaagtctagaatacttgcatgtagccaaagttaagttattatcaacttaaattgcctattataactacacagtttttaaaatgtaagccccatggtaaccacaaagaaaaaaattacggcagatacacaatgaaaaagaaaaaaaaaatcaaagtttatcactacaaaaaaaatcaccaaaccacacaggtaaactataagagagggaaaaaggaacaaaggaaatacaaaacaaacaaacaaacaaacaaacaaaaaacagaaaatgatctaacaaaatgtcaagagtaagttcttacctatcaataataaccttgaatgtaaatgaattaaattttccaattaaaagatatagagtggctgaatgggtagaagacaaaacccaactatatgctacctacaagagatttgctttacccataaggacacacgtagactgaaagcgaagggatgaaaaatgatattcaatgcaaatggaagccaaaagactacaagagtagctatacttagataacagataattcaaaaattgaaaggggagacaaagaaggtaaatctatactaaaggggtcaattagcaaccaattaaaacaattctaaatagatatgcacccaacactagagcatatataaagcaaatattataacatctaaagagtgatacagactgcaatacaataatagtaggagatttcaacaccctactttcagcaatagatagatcatccaaactgaaaatcagcaaaaaaaaaaacactggatttatactgcactctagaccaaatggacctaacagatatttgcagaacatttcacccaccagcaacctacagaatacacatttttctcaaaagtacattgaattttctccagaatagattatatgttaggccacaaaacaagtctcaacaaatttttaaaaatcaaaagcatattaagtatttttctgatcacaatggaataaaattagaaactgataagaggaagaattttggaaatcgtgcaaatacatggaaattaaacaacatgctcctggaacaaccaatgggccaatcaaaatatttaaaatgaaaatttaaaatttcttgaaacaaatgaaaatggaaacacaacacacctcaatctatgggatatagcaacagcagttctaagagggaagtttatagcaataaacacctacatcaaaaaaatagaaagatatcaaataaacaacctaacattgtacctcaaggaagtaaaaaaagaaaaaaaaaagaacaagctaaatttaaaattaagaatgaagggaataataaagatcagagcagaaataagtgaaatagaggctaaaaaatagaaaacatcaatgaaacaaagaattattttttaaaaagataaactaaattgacaaacctttcgctagacaaagaaaaaagagataatacacagataaataaaatcagagattaaaaagaagccattatacctgataccacagaaatacagagaatcataagagacaattatgttgtgcacatgtaccctagaacttaaagtataataaaaaataaatatatatatattaaaaataaataaaaagaaatagaaaaaataaaaaaaagaaaatctagaagacatggatattttcctggacacatataacctaccaaaattgataatagaaaatatgaacagatcaataatgagtaacaagattcaatcagtaataaaaatttccgatcacagaaaaccatgggacctgatggcttcattgctgaattctactgaatatttaaagaataattaataccaattcttttgaaactattccaaaaaactgaagaggagataagttcatctaaattcattctatgaggccagcattaccctgatacaaaaacaagacaaggacacaacaaagaaagaaaactacaggcaaaaatcctcaacaaaatacaagcaaacaaaattcaacagcaaattaaaaagagagttcaccatgaccaactgggagatggaaggatgattcatcatatacaaatcaataagcatcatacatcacattaataaaatcaatgacaaaactgatgcaaaaaaagcatttgataaaatttaaaattccttcaggataaaatctctcaacaaattaggtatagaaggaacataccttaacatgataaaggccaaatatgataattccacagctaacatcatactgaacacggaaaagttcaaatcttctcctctaagatctggaacaagacaagcatgcccactttcaacactttcatctacccagagcaattaggaaagagaaagaaataaagggtatccaaatggaaaaggaggaactcaaactgtccctgttttcatataacataattttatatattaaaaaaaccctaaagactccaccataaaactattagaactaataaacaaatttagtaaagttgcaggatacaaaatcaacatacaaaaatcagtagcacttctatgtgccaataaaaaactatctgaaaaataaaccaaaaaagcaatcccacttacaacagttacaaaaaaaagatacttagcaataaatttaaccaagaaggtgaaaaatttctacaatgggaattataaaatgttgatgatgaaattgaagaggacacaagtaaatggataaagatatcttgagttcattgattagaaaaattaatattaaaatgtccatactactcccaaaagatctacagattcaatgaaatccttatcaaaattccaatgacagtttttcaaagaaatagaaaaaaccctaaattcgtatgaagccacaaaacatcttgaatatccaaagcaattttgagtaaaaagaacaaagctgacggcattgtactagctgacttcaagataaactacaaagctatagtaaccaaaacagcatggtactggcattaaaatagacacatagaccaatggaacagaagagagatcacagaaataaatccacgcacttaaagccaattgattttcaacaaacatgccatgaatacacattggggaaagaagagtctcttcaaaaaatggttctgggaaaactggatatccacaagcagaagaatgaaagtagaccccgtctttcatcatatacaaaaaatcaaatcaatattgactagaagcttaaatcaacactaatgataaaattactagaataaaacatagggaaatccctttatgacactggcctaggcaaagatttttttgataacatctgaaaagcataggcaacaaaagcaaaaattgataaatgggattacatcaaactaaaaacttctgcacagcaaagtcaacaattaacaaagtggagagacgacatacagaatgggagaaaatatttgcaaagcatacatctgataaagggttaatatacagaatacaaaagaaacccaaacaactcagcaaaaaaacaaatacagtcatgttccacataacattttggtcaatgataaatgggatctaagtaaactaaagagctttggcacagcaaaagtaactatcaacagagtaaacagacaacctacagaatgggagaaaatttttgcaaattatgtatctgacaaaggtctaatatccagcatctataaggaacttaaacaaatttacaggaaaacaacaaacaacctcattaaaaagtgggcaaaggacatggacaaacacttctcaaaataagatacatccagccaatgatcatatgaaaaaaggctcaacatcactgatcattaaagaaatggaaattaaaaccacaatgagataccatctcagaccagtcagaatagctattattaaaaagtaaaaaaataacagatgctggtgaggttgtagagaaaaaggaatgcttttacactgttggtgggggtgtaaattagttcagccattgtggaagaaggcgtggcgatttctcaaaaacctaaagacagaaataccattcaacccagcaatcccattactcattactaggtatatacccaaagtaatataaattattctcttataaagacatggcacacatatgttcattgcagcactattcacaataccaaagacatggaatcaacctaaatgttcatcaatgatagaatggataaaaaaatgtgttacatatacaccatggaatactatgcagccataaaaaagaacgagatcatgtcctttgcagggacatggatgaagctaggggcaattatccttagcaaacaaatgcaggtacagaaaaccaaatacagcatgtcctcagttataagtgggaactaaataatgagaacacatggacacacagaggggaacaaaacacactggggcctattgaagggtggaaggtgggaggagggagaggatcaggaaaaacaactaatggatattaggcctaataactgggtgatgaaataatctgtacaacaaacccccaggacacaagtttacctatggaacaaacctgcacttgtacccctgaacttaaaagttaaagaaaaattttggtcaatgatagcatatataaaagtgattcaataagatcataatattgtattttttgtgccttttctatggttagatatgcttaggtacacagatatttaccatcatgttacaactgtctacagttttcagtacagtaatatactatacaggtttctagcctaggagcaataagctatacaatctaggtctatgtaagtacattctgtgatgttcacacaataacaacattgcgttgtaatgcatttttcagaatatattccaacccttaaatgatgcatgactgtaatctgattttaaaatgggcaaaagacctaaatagacatttctgaaatggccaacaggtatatgaaaatatgcttaacattaccaatcatcagaggaatataaataaaagtcacaatgagatatcaccttgccccaattagaatgggtattctcaaaataccaaaaaatgacaaatgctagtatagatgtggagaaaagagaactctcatacacttttggtggtaaattaggacagccattatggaaaacagtatgaagtttcctcaaaaaattaaaactagaactattatgtgatccagcaagctcactattgtgtatatgttcaaaggaaatgaaatcagtatgtcaaagagatatctgcactctcatgtttattgcagcactattcacaaaagccaagatatggaatcagcctaagtgttcatcaagagatgaataaagaaaatgtcacaaatatacacaatggaattatatttagccataaaaaatgaaggaaatcttgtcatttggggtaatatggattaatctagaggatgtgatgttaagtgaaataagacagaaagagaaaaacaaatactgtatgatcttactcatatgtgaaatctaaaaaagttgacatcatagaagtagagtgtagggaagtggtgaccacaggcagaagagtgtaggggtaagaggaggatggggagagattagtcaatgggtacaaagttacagttagataagagaaataagttctgtgttctgttgtacagtagggtgactatagttaacgacattgcattgtatatttcaaaatagctaggatagagtgttttcaatgttctcacaacaaagaaatgataaatgtataaggtaattgatatgctaaatgccctgatttggtcattacacaactatacatgtactgaaacttcaccctgtacctgataaatatgtacaattataatgtgtcagtaaaaaacaaaacaaacataagagccgtatataaaaaacccacagccaatatcatactgaatgggcaaaagctggaaataattcccttgaaaactggcacaagacaaggatgccctctctcaccactcctattcaacatagcattggaagttctagggcacgcaggcaagagaaagaaataaagagtattcagattcaaagagaagaagtcaaattatctttgtttgtagataacatgatcctatatctagaaaaccccatagtttcagcccaaaagcttcttaagctgataagcaacttcagcaaattctcaggatataaaatcaatattcaaaaatcactagcattcctgtacacaaacaacaggcaagcagagagccaaatcacgaatgaactcccattcacaactgctacaaaaagaataaaatacctaagaatacagctaaccagggaggtgtaaagtctctacaaggagaactacaaaccactgctcaaagaaatcagaggacataaacaaatggaaaaacattccatgctcatggatagaaagaatcaatattgtgaaaatggtcatactgcccaaagtaatttatagattcaatgctattcccattaaactaccattgacatgctacacagaattagaaaaaactattttaaaattaatatgaaaccaaacagagcccaaatagccaagacaatcctaagcaaaaagaacaaagctggaggcatcatgctacctaacttcaaactacacaacaaggctacagtaatgaaaacagcatggtactgggacaagaacagacacatagaccaatggaacagaaaaaaagaactcggaaacaagtccacacacttacaaacatctgatcttcaacaaacttggcaaaaacaagcaatggggaaatgattccctatttaataaatggtgctgagagtcctggctagccatatgcagaaaactgaaactggaccccttccttacaccatatacaaaaattaactcgagatggattaaagacttaaatgtaaaatccaaaactataaaaatcctagaagaaaatctaggcaataccattcaggacatatgcacaggcaaagatttcatgataaaaacaccgaaagcaattacaacaaaagcaaaaattgacaaatgggatctaattaaagtaaagagcttctgcacagcaaaagaaactatcatcagagtgaacagacaaccaacagaatgggagaaaagttttggaatgtattcatctgacaaaggtctaatatccagaatctacaaggaacttaaatttacaaaaaacaaacaacctcattaaaaaatgggcaaaggacaggaatggacacttcataaaagaagacatacatgggaccaacaatcatacgaaaaaaaggtcaacatcactgatcattagaaaaacccaaatcaaaaccactatgaggccgggacagtggctcatgcctgtaatcccaaaactttgggaggccaaggtgggcggatcacgaggtcaggagattgagactatcctggctaacacggtgaaaccccttctctactaaaaacacaaaaaattatccaggtgtggtggcatgtgcctgcagtcccagctacttgggaggctgaggcaggagacttgcttgaacctgggaggcggaggttgcagtgagccgagattgcgccactgcactccagcctgggcgacagagcaagactctgtctcaaaaaaaaaaaaaaaaacacacacacacatgcacaatgagataccatcttacaccagttcagaatggctattactaaaaagtcaaaaaacaacagatgctggcgagattgcagagaaaaaaagaatgctatacactgtcggtgagagtgtaagttagttcaactattgtggaagactgtgtggtgattcctcaacaatgtagaggcagaaacactatttgacccagcaatcccattacttagcatatacccaaagtagtataaatcattctattacaaagatatgcacacatatattcactacagcactattcacaatagcaaagacgtagaatcaacctaaatgcccatcaatgacagactgaataaagaaaatgtggtacatacacaccatggaatactatgcggccataaaaaggaatgagatcatgtcctttgcagggacatggatggagttggaagatactatcctcatcaaactgatgcaggaagagaaaaccaaacaccacatgttctcacttataagtaggagctgaaagatgaaaaaagagctgggcttatgtccatgtctggttttggtaacagagtaatgttggccttgtacaatgcattagggagaattgccacctcttcaatttttagaaacactttgggaagattggtattagttctttatacatttggtagaattccacagtgaacccatctgatcctgggcttttcttcaatgaaagaattattatttattttaagttctgggatacacgtgtagaacgtgcaggtttgttgcataggtaaatgggtgccatggtggtttgctgcacctatcaacccgtcagctaggtattaagcccagcatcaattagctattcttcctcatgctctccctcccatggcccccaacaggctccagtgtacatcgttccccctcacgtgtccatgtgttctcatcattcagctcccacttggttttttttcatcatcactgctgtttcaatgaaaacataaattcaaaccaatttcacatttactgaataattatggaagctagaaacccacagggtaattacacaaatacaaaatacctacctaaataatatcggacatatactgggtattttggttacctacagctacataagtatttactgtaaaatataaaagtttaaaacaactaccaatttaacatctctaatgatagtgtatatcaggaattggggtaagagatagctgaatcattctcatggcatcatcagagtttactcactggtattcagatgacaaatgggcttttctggagagtccaagatggcattattcacttgtctgctgccttgataaggatggctgaatgctagtctcaggtggaactttgctgcaaggcttcctctaatgtaacctcaaaatttcagaacacacttctgccacattctataatcaagcaaatgatcaaagccagcccagattcccaaagagggaaattggtggccatgtttttacttccataatcagggagaagggcaggaaatatgatccagaacaaacagaaaaatgagttagtagcagcagacacagaatgacagagatgatggaattaacaagaaatgacattaaaacatctattataagtcttctaaacaacctcaaaaaaataaaagaatgcataatcatagtgagaaaaatggaagacataaagaagacctgaaaggaacttctaaagttaaaaatatataaaatgaaaataactggatgagattaacatcagtgaatactacagaagaggaaaaaaatagaacttaaagacttaacaatagaaactagccaaaattaagcccagagaggggaaaaaaatataaaaaaaaaacaaaaaaattgagtgcatcaattacccatatgacaatatcaagtgatctatcttgtgatctatcttatacgtaattggagttccagaaggaaatgagagagaaaaaaacataaagaaaaattttaatgcaacaataatcatatattttccaaatttgataaaaactctaaccccataaattcaagaacctctcaatgaatctcaggaagaataaatataaagaaaatgataccaggacatatcataatcaaactgctgaaaacaagtgataaagagagtatcttaaaagtagccagatttaaaaaatacaaattacctacaaaggaatgaaggttaaaagggaaacaggcttattgtcagaaacttcacaggctggaatacaacagaataacatcattaaagtattggaaaaaacctgtctacatataatggtatatccagtaaaagtgtcttcccatattaaaagtaaaaatacttcctcagataagcaaaagttgagcgaagtcatttccaccagacctgtactaaaaacaaaacacattaaaggaagttcttcaagacagaaagaaaatagaaatttggatctacataaatgaaagaaagaaacaggcatagtgggtagaaaatatgtggttttaaatcaatgtataataattgaaacacacatactgaaaggaaaattaatgcaggagtgttgacacctgaaatgcaaatcaagaatgggaagaactcgctttttggccgtttttcaaataaaattatttttttcctcataaacaacagcacaaacaacggacaccaatacacacacacacacccctcccccaaaatgtttgactatggtattccatatgtctgagtagaatatataggtgataaacatatacatactatttttgaatgcctagcccattgctctgactggattgaaaatgccttaagacaattaggtgttttctccttgaataaaattcactgacaacactttgaaattgtaacgatagatggtgaatttatgaactgccaaaaggcatgtgaaaaccaagaaaaacagttaccctgtgctaaagcccacattgccatttgttaaggacagctcctttccagaacactggacagatgacacatgtttgttcattggctctttttttttttttttttgagacagtcttgctctgtcgcccaggctggagtgcagtggcacgatctcagctcattgcaagctctgccattctcctgcctcagcctcccgagtagctgggactacaggtgcccaccaccatgccctgctaatttttcgtatttttagttgagaccgggtttcaccgtgttagccaggatggtctcgatctcctgacctcatgatccacccacctcagcctcccaaagtgctgggattacaggtgtgagccaccgcgcccggcctgttcattggcttttatatagaagtattaactgaatgcctgctatgtttatggacaacattgtagctaagaccccatatattataattcctgacattcactcaggactttgcaatagatagctcgcttttatatctaccttgctttctcttcataacaataaatgaggagggtggatattattatccctttttcagttgaggttaagaaagccctgactcccaactcatcaccctacttccttcactaaagctgtaatatcctttagactctgtcataaacagaagccttcaggtctcagctgaattcagttttttcatggggacttctcatatacagcagatcttccaataaggtcgttttgttataatgttgatgaaaaaaaacattgattcctggccgggatcactgtccatgggaagttcacacattcttcctatatctacatgggctttcttctgttattattaatatggtttccttccacatcccaaagatgggcatactaggttcgttggcctgtctaaatggtctcaatctgatgagtgcaggggtgtatgtgcgagtgtgtcctgtaatggaatgatgtcaaaggctggttcctactttgctccaagctgccaggatgggctctggccaccagtgaccctgagctggaataagcaggttggaaaatgaatgaatgaataaatacaagttattataaaataaaaaatttttaagtacatgataatcatacaataaacaatgcagtatgaaagcgcttagtgagattactatatttgttgtttgtttctgaactgcgtgatggtaggaggtgcttctgacaatgttcattttgcaaacatttattctttgattgaatctaccaccatgattgccctcactctctgattcaccgaaaattgagtaaatcattatcttgtttttatttttctttcttaaatgtatatatagttcacatttatttcaatgtttaatagtataagtgttttggtctttatttagaagtttggtgatgtttttgtgaccagaaatatgccacaggaatttaactcttgtttatatccattatcctatgataaaattggttttgttatacatcattttcttaaaattgtagtttccaagaacctaaccaggacattaagtgagaatgtactgtactcacgtaggtcttgtattatttcttcatagcatatagttattaaagtgagattttaaaaaaaatgtttggctcccacattggtctcagcttcaggcaggcagaagctttgactctaccatagcaaccccagcactctgaataatgcctggagcatggtaggcactcaatatatgtggtctactaaatgtgtgttggttcctgaaatgcttctagatcaaaactgcatagcaaaggaaggaatctgtctatggttatgtagtttcagaataccatatctatatgtactttataatgaaaagcttgcaggaaaattggctattattactttattaaatgaatttgagtcactcatcctttcttcagattattcatccataaaataacaatgtttgaaaaccatataggtattaaacagtgctcctcaaagcccagatggttctgtgagggttgaggaagagcaaagagatacatttaagtttttttcttttatttacataccaagtaaaagcactacacatattaaatggcagtccaaggctaggtttggttctgtgtccctacccaagtctcatcttgaattgtaatccccacgtgtcaagggagagatctggtgtgaggtgattggatcacagggacggtttcccccatgctattcttggtatagtgagttctcacaagagctgttggtttttaaagtattcggcagttcaccctttgctctctctctcctgccgccatgaagaaggtgcttgtttgcccttcaccttctgctaccttctgccatgattgtgtttcctgaggcctcccaagccatgcagaactgtgagtcaattacccagtctcaggtatttatttatagcagtacaaaaacagactaacacagtttataataaaatgttcccagtaatattgaaggagcactataatgctccctaagaacttagaaacaaatgaaatcaagtaaatttttaaagtaacatacaatggatcataataaagacatataaaatctcttaagggaaacagaataacaccctacaatacgaagaaaacatccatcaggcaggagattgatcagcaataaagccaaaggaaaagtggagtcagagatgagaactctggaaattcccaaccggtctatgtccaggagaaaggaaagttaaatcagtgttcagaccttcaggcaaggtcattttttgtatgaaacaacaatactatgctctcttagcctgagaacattttttaaaatggattcatctcctgttttgattgatttcatgatttcaggcaaacttctgaatatttcatggttccctaaaatagtctgctgagaagaaaaattgctcataccatcacgaatattcagacccatgtgacagttgtatttctcatcatcaataaattggcaaactgatttatgtttttgtttaaaacacctagttagtgttcactatgttcctaacattgttataagtgcttcaaataataatttattacatcttcatagcaactccatgtggtaggtacaatcctataaagataataatagtaaagtaatgcactttttctgttaaaaactatttttaattgacaaataattatatctatttatggggtacagtaggatattttgatatatgcatacattgtgggatgatcaaatcaggctaattaacatgtacaccaccttacgtatttctttgtgatgagaacacttaaaatccacccttttttcaattttgaaagatttgggagattttatgggtcctttccaaaccatcacaataaagtaagtcgcacaattttattttgttttctggtgcatataaaattatgtttacactacatggtgtagtctaccagtgctaagatttctctgtagcatgcaatgctgtttgatagcattttacatgcagtggaatttctttcaaaattggagtcaatcttctcataccctgcttctgctttatcaactaagtttatgtaatattctaaatttctttgttgtcatttaaacaatacgcacagcatcttcacctggactagattccatttcaagaaaccactttctttgctcattcataagaagcaactccttatcgaataaagtttcatgatgagattgcagcaattcagtcacatttcaggctctacttctaactctagttctcttgctattttcaccacatccgtagttacttcctccactgaagtttttaacccctcaaaattatccatagaagttggaattaacttcctccaaactcctgttaatgttgaaattttgaccttctcccatggattacaaatgttcttaatggtatctagaatgatgactcttttccagaaagctttaaatttaccttgtcttggtaactgtgaatactgctgcagtgaatgtggagtgcagacgtttcttcagcttactgatttttattcctttgggtggcatagctggatcatatggtatttctacttttagttttttaaataaccttcatactttttccaaaatagttgtactaattcacatttccacaacacagtgtgtgatggttcccttttctctacatccttgccaacactagctagcattcacctttttgatgacagccatacttacaggtgcagggtgatgtctcattgtggtttaatttgcatttccctgttgagtagtgatgttgagcatttttaactatatctgttggccatttatatgtcttcttctgagaagtgtctatccatgtcatttgcccatttttaatacgagtatatgttttattgagtcatttgagttccttatatatttttgatatgagtcccttatcaaaatgaggccctttgacaatatatttgcaaatattttctcccaatctgcaggttttcttttcactctgttgatggcttcctttgccatgcaaaagattttttagtttgatgcaatcccaattgtctaattttgcttttgttgcctctgctttgggggacatacccatgaaataattgcccagaccaatgtcaaggagcttttctcctagtcttctcttatgagttttacagtttcagatcttacatttaagagtctcacccatcttgagttgattctactatcaagggagagataaagttccaattttatttttctgcatgtggatagccactttttctaacaccatttattgaagagactgttctttcctcattgtgtgttcttggcacctttgttgaaaatcaattgaccacagatatgtgcgtttatctggggactctctaccctattcgattcattgatgtgtctgtttttatggcagtaccctgcagttttggttactataactttgtgatgtattttgcaatcaggtagtttaacgccttaacctttgttatttttgctcgagattgctttggttattcagggtctattgtggctccatacaaattttaaggttgttctatttctgtgaaaaatgacattggaattttgataggattgcactgaatctggagatcactttgggtagtatagacattttaacaatattaattcttccaattcatgaacacagaatatctttccatttctttgtgtcttcaatttcttttatcaatgttttatagttttcagtgtataggttcttctcctccttggttaaatttactccagagtatcttattttttatagctattgcaaatggaattgttttcttaatttttttcagatagttcattgttaccatatagaaacactattaaattttgtatgttgattttgtaacctactttactgaattttattcatcagttctaacaaatttagggggctgagggaggggagagggagagggagagagatttgtactgtactgtaaagaattggttcacatgattatggaggctaagaggctcaagagaagcagttggaaaactgaagacccaggagagccaaaggtatagtatcagtcaaagttgaaagtcctgagaaccaagagagctgatggtataaattctggtttgaatccaatggcctgagaaccaggagagcctgtggtgtagaatttagtccaagtctgaaagcaaagaaaattgatatcccagcttaaagacaagcagagataaataatttttcttactgagccttcaattgattggatgaggcccattcacattgggaagggcaagctgctttattgagtttaccaattcaaatgtcaatctcatccagaaacatcctcacagacacaacacgaaataatgtttaagcaaatatcttcatatcccatgacccaatcaagctaacacataaaattaagcattatacttgtgtacacaaatagacatttttaacttagctgtgcatttctccaaatcctttagcaaattacaaataccaatcaagaatgctgacggaaacatacctacttgtgtgactacaagttaaaacactgataacaccaggtgttggtgaggatgtagagttgactggaactcctatagatcactggtatgagtgaacatgttacaatcactttggaaactggaagtttttgtgatagttaagtatacacttacctatgatccataaatcatattcctagatatttacccaagagcaatgagtatgtgtgtccataaaatgatttgtacatggatgttcttcatagcagctttcttcataatagccccaaactagaaacaaccatcaactggagaatgaacaaaaaaatgcatattcataattagcaataaaaatcactactgatacatgtaataacatagatttgtctcagaaacattatgttgaataaaagaagcaaggcagaaaagtggctaatttttgattatttatgtgaagttaataaacaagaaatctgtgatgatagaagtcagaatagtagttatcctatagaagagcaggattgctgatatagtttgactgtgtccccactcaaatctcatcttgaattcccacatgttgtgggagggacctggtgggaaataattgagtcatgagagcaggtctttcctgtgctgtcttcatgatagtgaataagtctcacaagatctgatggttttaaaaacaggagtttcccttcacaagttgtctttctttgcctgctgccatccatgtaagatgtgacttgctcctccttgccttccgccatgattgtgaggcctcttcagccatgtgaactgcaagtccattaaacctctttttcttcccagtcttgggtatgtctttattagcagtgtgaaaatggattaatacagtaaattggtactgggaatgggttgctgctgaaaagatacctgaaatgtggaagcgactttggaactgggtaacaggcagaggctagagcagtttcgagggctcagaagaaaacaggaaaatgtgggaaagtttggaacttcctagagacttgttgaatgctttgaccaaaatgctgacaatgacatggacaatgaaatctaggctgagatggtctcagatggagatgaggaacttgttgggaactggagcaaaggtgactcttgttatgttttagcaaagagactggcagcattttgcccttgccctggagatttgtggaactttgaacttgagagagatgattagggtatatatatctctatatatctggtggaagaaatttctaagcatcaaagcattcaagatgtgacttgggtgctgttaaaggcattcagttttaaaaaggaaaccaagcataaaagttcaaaaaattcacagcctgacaatgcaacagaaaagaaaatcccattttctgaggagaaattcaagccagctgcagaaaattgcataagtaatgaggagctgaatgttaatccccaagacaatgggaaaaatgtctccagggcatgtcagacaactttgtggcagcccctttcatcacagacatagaggcctaggaggaaaaaatggcatggtgggctgggcctaggttccctctgctgtgtgcactctagggacttagtaacctgcatcccagctgctccagctgtgactaaaaggggccaagatacagctcagaccatggcttcagaggatgcaagccccaagccttggcagcttccacatggtatagagcctgtgggtacacagaagtcaagaattgaggtttgggaacctcctcttagatttcaaaggatatatggaaatgcctggatgtccaggcagaagtttgctgcaggggtgaggcactcatgaagaatctctgctaaggcagtgcagaagggaaatttggggtgggcacccccacacagagtcctcactgaggtactgcctagtggaactgtgagaagagggccaccatcctccagaccccggaatggtagatccacagaccacttgcaccatgcacctggaaaatctacagacactcaacactagcccatgaaagcagctgagagggaggctgtaccctgtaaagccacaggggcagagctgtccaacaccatgggaactcaacccttgcatcagtgtgacctggatgtgagacatggagtcaaaggagatcgttttggagctttaacatttgactgtcctgctgtatttcagacttgctgactttttggacttgtagcccctttgttttggccaatttctcccatttggaatggctgtatttacccaatacttgtatctgcattgtatctaggaagtaactagcttgcttttgattttacaggctcataggttgaagggacttgccttgtctcagatgagactttggactgtggacttttgagttaatgctgaaatgagttaagactttgggagactgttggggaggcatgattggttttgaaacataaggacatgagatttgggaggagccagggtggaatgatatggtttggctgtgtccccacccaaatcttgagttcccacatgttgtgggagggactcagtgggaggaaattgaatcatgggagcaggtctttcctgtgctgttctcatgatagtgaataagcctcatgaaatccgatgattttaaagatgggagtttccctgcacaagctctctctcattacctgctgccatccatgtaagacatgacttgctcctccttgacttctgccatgattatgaggcttccttagccacatggtactgtaagtccattaaacctctttttcttcgcagtctcgggtatgtctttatcagtagcgtgaaaatgaactaatacaattcctgattggaaaactacacaggaaactttcgggatgatggaaatattttatattttgatccaggccctggtctcatgggtttatgtgtacatatatgcatacatatatgtaaagtataagtatacttatatacaccgaagtatataaatatgcattgtagacttgtgcatctcactgggcgtaaagtatgccttaataaagaactgtgaaaaatagcttcaatacaaaaaattatgctaaataatgaaatgaaaccaaatttaatattttcaacaatttggagacctaaaccaatacttgtgaatagacaactctctcccagatggcctaagctgagcaatttccataagtcaaacttatcaagctattgcttgagtttctggggttcagatcacacacaaaaaaagcccaaatcaaaactctgtttgaccctacataataactcacaaatccacttggattctggccagtatgccattctatttcagctgcagtgtcacaccttgcattgtagacatcatatcacctgatatttttgtatcatttgtaaataatttagcagcaacactgactaaaatttactataccacccaaaatacaaaacacaagagaatgacaagttaaaattattttattttaaaaaatagtctatatgcaaatagtcccaagtgtttaactgcatgatccttgtgggtctacacccctgattttaaatcctatgcttgctgtattctttcacagtttgccacagagtattttcttaatgcacaacagtaaaacaaattcaccaatgaaaatttattcttggctgggtgcagtggctcacacctgtaatcccagcactttgggaggccaaggcaggtggattacttgaggtcaggagtttgagaccagcctggtcaacatggtgaaaccccgtctctactgaaaaaacaaaaattagctgggtgtggtggtgggtgcctgtaataccagctactcaggaggctgaggcaggagaatcgcttgaaccccagaggcagaggttgcagtgagccaagattgcaccactgtgctccagcctgggtgacaagagtgaaactccatctcaaaaagaaaaaagaaaagaaaaaaggatttattctcaccaaaataagaacacaaggcaagtgataaatgtcacattaaattgtattaatattgcctaatttgtaatccacaacttcacaatataaaaaatatggattatttttaccaattccctctttttctactatgaatactttctatactcacatagaatagttcagtgaaatatacttggtacacctcagtgaaatactggctgattgattgacacaggtggttaatacaagaggcccttaagatgaagatgacattgatattatacaaacacgcagaatcacaaaatactctcagcctgtttgccaggaggcaaataggacacacaagtgggaagtttggtgtttctggaccacacagtctctgccacggcaaagaagatcagccagcctcctcaactcagtacaattcagacatggtcatgaggtaggggctatagtgagaaatgtgttagaacccacacctatatatgcacatatgcaacacaagctatgtgtttaagattccagaaactgtgtaagaaacaagatgttggaatgttgattggatttacatgttgatgaaatttcagtcaactaagcctagtatcatgcaagattactgtgaaaagtttaattgtaccaactgctcttgtttggaacaaagaactgtcagctctctttacattaaccatatttctctcccccattgctactgcaagaaccaaaaagagagtacttaaaactgggttctacctgcaaaatctgcaagtcagtcagtcatggtttacatgcatgtcaatttctacattatattttcctaaggcagacatttgacagatataaatcttgcctcagcaaggcccaaaggaaacatttgtcatacctccaatggtcattcttgattaaagaaatcacagcaaaacaaattggaattgcaaactcagcttatatcttttctctcacataatttctatatcttgaagccaacttctttaaccataaaatgtgcattctccacataggatacaagactatagctgtgaactattttcccaatgagttacatatgatgccttaatcgttaatagtaaatagatgtactatttgtatgaggtgaggtttttttctcatattttagaaagaatcatcattgtcttcttattgtgaattatcaaaggcaaataaaaaacagcctcttcagtacctagcatattttcattagaaacaaattctattgcgatgcaaattctttggacaaaagtgaagcactttgaagattttctaatatttttgtcaaaagaatacacatgtagatgtgtactttgccttttccataaatattcaaaatgtattctgaaattaaaataaaatatttctataaaataaacacattcacttggtgttttttctttcatttgcatttaaagcagtaatcacaatatcacaagattctttgagtaaaaggccttctcttgaaaaggtagataatagaaagaacatccagccccttgcccctagatggagggataaaaacagatagatgacaaacattctataaattaactctagccacaaaactactgcaaatcaaaacaaccacaaaacctccacaaaggttatgtgcatgccggagcacatgtgtctgggggtcatgaggcatccacatattacaataaattttccccacaacccttattgtaaggttgaactattagggaaaaatggagcagatgctctctaaataaatatgatgtctttatttaatttcctagatgccatgccctcactaattatttttgttctttatttgaagggaaatagataccttagaagaaaactccttttaaatgttttcataagctcaatcaaactaatcacatgttaaaagccagaaaagaaattaaaggagagcttaagctaatatgatgaattttagagaggcaaccaaggcaatttataccaaaagtcaacaaaatttacacaaactcaattgtgtatttttttagattatgcgcacattactatgaaaatatccaggcaaaatgtatgaactgttaaattgcaattgaatttggcaatctatacaactagttgtcattctaataattcatttaacattattgaaatcagtattttgtcccagcgtgttatcatgatattaactgaatttattcaaaaaggagacattatttttatctcaggctgattgctagcaccctcaacttcaattttgtttgatttactgtgcatattgtattattactaagacagatgctctgagacacataatccttattggtctatatatattggtgagctttctttggtaaaaaaaatctggctgggaaaaatatcttgtttgtggaattaagcaaaacattagcatttcaaatatttttgtcttttaaaacaccttgtgccacaactaactcaatagtgggaaaaagatctttgttcagaactgtatgtgtgtaaaagagagagagaattcaagaaacaggtgttatatatttcagaaactcatacttcgggaaagaatagaaacattatttgaacctttagcccaaagactatccaattgcacttagatgctatttctgttccaggttaatttcttagaaaccattgcaatcttattctagtttcctatttaattttatatatgttatttacttttgaacatgggctaaactcaaaaaattttagtcagtgaaggttacagtttagtcccatattacctacaatcttaccgtaagtatgcccacaaaatgtttgccttacgacagctctatgagtaagactatctttgagcttaaactcaatcgccttgggtgatactcaacaggtgtgtatcttttgttttcctttggcatggcccaattttacacagagattttggtagaatgacttgttcttctcatatctttttagcttcagaatccggataactcaattaaggaaataaaagtgggagaccttcaaaggagaacaagtaatttatgggacctgaatttctgaaataatattaaggcaacattgggcttcatggcaaaacaccagaggttgggaagagttgcagatttactcttttgacattcacatcacctccctccctccattttaatagatgcttttaccaactaatttggtctttctgatgctttgattaggcaagttacagatatattttaatagttgcaaaaatgaatacttcaaagaaagcatagaccaaggaaatatattgttgaaaagtaacccctcagcttagagaagaaaaaatacacaatgttattctactatctataaatgaggtactaactggatgatgtgtgattaccagtgtgattaaatggcaaaaacagacacatggagaagctaagtagtatgctgaggcattgtctttttgccaagttaatacactatgcacactgttttccatacaagattctcaagtagtaactatagtaaagagcgtaactcaaaaaatggagtgcctaggtggagaggcatactggaatgcatgaaggtgtttcattatgtatgatgagaacagtctccaccttctgaagagtcttcaaaaaagcaaactggaggaaaagtcacacctttaaggtgcaaatccaacaaagatgtcttaagattctgaggaagaatttgctccttgccagtcagttatttccagactgcagcatgtagatgataagatcaagatatgatcgaagagacttttacttgtgcaagaaggtagtaaccatgctactatttttaatccttaagatttaaaacatgcatttaattcttttaaagatgtacttaatgtatattctgatagcattccaaggcatttccattgaaaagtacatgctataaattcagtagtcttaacatacataatacaatatattatgttgttcgcacgaatgttcattgtagcacttttcacaatagcaaaaacatggaatcaacctaaatgtccatcagtgacagattggataaagaaaatgtggtacatatataccatggaatattatgcagtcgtaaaaaagaacaagattatgtccttttcagggacttggatggagctggaggccattatcctccgcaaactaacagaggaacagaaaacaaaataccacatgttctcacttataagtgagagctaaatgatgagaactcatggacacaaagagaacagacactggggcctgcttgaaggcagagggtgggaggagggaaaggagcagaaaaaaataactattgggtactaggcttagtacctgagtgatgaaataatcagtacaaaaaaaaccctgacaccagtttacctatataacaaatctgcacatgtacccccaaacctaaattaaaaggtaaaataatcatgttttttcaatttaataaaaagaccccccaaaaaatattgcccttcagttaacaaataaagtgtgatgcgaggcaagacatattagtttactgctaattcatagatgaagtctgatgatttactttctgcatctgaatctaacaattcttattgggagaaaaaaatgtgtacatatggttctttggtatgtttgttgagtattatttttgttgattatgtatcagccaacatattgtgaaaactgtcatgctttttaattatgtgtttttataattaaggtgaattattagaaaagcccaatgattaaaactctaattatgtaactgttattttcacaggaagcttattgagactcacctgagaactattccaagtcatgcattttctaatctgcccaatatttccagaatgtaagtttttttaatataaagaaaagtttgcatttgtgatatgttattctctaaacgtgttctatcaagaaaaatacttggtattatacttgcataaatcaatggcagttatattgtcaatgtatatgacaattttatgtacatgatttttatttcattttgctatatctctactccctaattcctacatgattttttaaaacctaaatcaaatttaaattcatttgattttgagcagttcataattctcgatgtattttaatatatcttgggatatggcaaaaccttagctgtaaatctctcctataaacatcccgtagtttataaagtaaacatatatacagatagacaaacatccatctgtcctagtcaccaagtcttgaatcacctttcactactaatacaaatatttacattttgttataaacgtagccagtggtttcagatctctcacgttaaaagagaattaaaaataattctaaaccttaaaaattgaattgctatccacttacagtaaggagaaaagggattttccatattgggttgacaaagagtgaatgaaatgaagcaggtctttatttcatttaattgattttgacaggcaatccagatagttcaggcatgcgaaataatataaccagaagcaacctgtacagtttttggccaaatgtactcactccgtggccattttgttagtgtttctgtcatttcagtagttctcaaccacagacgactctacccctagaagcatttagcatttttggttgctaaatgcccactagagagggggctgctactggcacctagtgggtaaaagtgaaggttgctgccgaacattctacagttcataggacagtccccacaacagaattatctagtccaaaatgtcagcagtgctgaggctgacagaccatcctactgaacatctctgcagttttttatgttgctaacaagtccttcctctttcaaattcttgcctctttgttttccttgatattgctctctcattcctcttcttgtctcacctggctactcttccttagtctccttttctgacttcctattttatttttgccagctacttaattaccagctctttctttgtatattttgttctaattcctctataccccactctccttgagtaaacactcccattccttgggctgcactatttcctaatacagctaatttccaaatattaccacttggatgtcccacaggctcttcaaaaccagcatatccaaaataaacacatcatcttcctcccaagctgttccttctcttttaacagcaccactgtagcatcctataagctaaaaaccttgaattctcctttagctcttccttttccctcatctaccttatacaactgcctatttggtgtctctgtttgcatgtcccaacagcttggccattacttcattcattcaacagatatttattgagccctactttgtgcctggcactttgctaggtgttccgtacacagcagtagacaaaactcacagcagttcagttttattcctaagagagtgatgagtatcatgatggggtcagttattgggtgatatggaaactcacataagaggtctattacctacacaggagcagggagaggagttggggaagacttcctgaaaaaaaaaatagcacctgacctgtgatctgcattatatagcaaagagcagaagggaaaagcctgggctttctgaagaattgaaatataataagtttcttgggggtagagcttaggcagggaggtgggcagtagaaaaaaataaaacttaggtctaagttagtacagggtcttgtaaatcatgtgaaggagtttaaaatcttccctaagggctgagccattcaatggttttaagcaggcaagagaaatggtcagattttcatttgagaaacattcccttggctatgtagtggagtgaggggtggaagtggagcaaggctgtaggcaggaagctagtgaagaggctgatgcagtgcccaaagtacaggggatggcaaattgaaggatgatcattgagtgggaataatgaaaaaggatagagatttgagacataaataagggagggctgatcaagtttctgattaggacatctgtgtggttgatcggcacattcatttaggcagagaagtgttttgtatatttgctgtggagggtcagggggtatgttaggaattcaatttggggcatatggcatttgaggtgcagttatattgagtacacatcaggacacagacagaattttttcattcatttgataaatatttgttcagcccctactatgtgccaatcactgctctgagagctggggatacatcagggaacaaacagacaaagatccatgtccccatggagtttccatttgaatgggaggaaatagacaatgaaccaaaaacacaataaataagtaaattagatactaatttagaaggaaataagtacatgggaaaaaaagtaaattagagtaaagaggattgggagttctgggtatatgggggcactcaggggagagattcaggtagagattgagagtcacaaacaactgggtgtaactgggaccaggaggaggcatccgcagagagggagaagctaaagagagtgaagaaagaacaattttaagagcatgtggtccctgaagaggcaggaggggatgagatccaaatagagggattggccttctagaggaagatggtcactttttacatcataacgaggaagtcatgttgtaggactttctccttagttcagctaaaagccaggttcttgtcacatggccataaaagattaggctcacagacactttgaagggtgacaaaaatagaatttattgggtgaaagaggaaaagagggaaacagggactctcagcaaagcgagagtcctcctagtccacttcccgcctcacagattgaatcccaggtaccaccccacaacaggagaggccaggctcctccccactataaatgaacttcccgaagctccaccccagtacacacttctcccagggcacaggcagttgaaggttctgctagggagcccttttttacttagctgtctcagttgtaggaaaagatgggacagatgcaggtaaactaataggcttattggtggggaattcaaggcattctcgtgttaaagtttcaaacatttctatgacttatcaaattattaaaggatatctaagaagatggaagatggaggtggcagagttagaaatttgatgagaagatttgaaataaaagtggtgagcaataagaagagggttggttgactgagatataggagacacccaggcagatctgaaggctccactgaggcttcccccagggagactgctggattctccagtctgggttaagtgataggggtccctgaaccctatcaagcatttaacaccttgtgttaatcccatttaccttgtacattaatctgtatctgtgagtactgtgagttccttgaaggtagggaacaggcctgttttgtcattgtccagaaggatgtctgtcatacaatgaatgttcaatacatatttgtggaataaaagcacatacacatacctgaataatgattaaagatttgatatatcttggggagaagaaagagatcagtaggatgatgctaggtttgtctgagatggttcaaattcccacttgggattctggcataattgttaatggcaccttgctttaactcacaaaactatcccagtttgaatgataagtcatatggtgactgtaatgattatatgatgtttaaatgcgaagaagaagtaggatctgatttttcctagttgtaaaaatggggtaagtaagcagggaatcacaatttttatccccctgaataaacgattcctgccagttgtcttcacaaccaagcaatcacagccatacaaaaagatgtcattaggttggagaaactggaacttccatttgataatatgggccgagtgactatccttctggaaccttgagaaagactcatacttcttaactgagaaattcagtagaagatttggagcaatggaaaagatgcttagggaaacaagttggcagccttgaaaaatgaatcttgctctgctagcttgctcagcttcatccatggtaaatccccacagtctctacacggtaaattaattcctttcaatctgttccattgtttcctttatgttagaaatatatttgtatcaaaacaatttatataacgttattatctgcaagaggcaaagggttaagagactgggtaaatcaaaggataattatttagagaacaggtaattcaaaatagaaagcacagagccattataatactcataataaccaagataaaaacttagaatggaacaatcagcactcctcttgtaaacattgcatcgatgaggatactttactggcagattcaattcaaactataggtcagtggttctcaacattgcctacacattagaattggctaagaagcttttgaaaaataaaagtacttgactcatccctcataaactctgatttaattatcctagaccgggtcttggacatctgtgtactttaaagcccttcaggtagtttaattgcatgtccagggttgagaatctctgctatggctatggctggaaaccatctgtcaattgttcattttcccaaatgtcatagaaatacctcacaatagaaagtggtcattgaatttggctgcattagtcattctcattacaagatggaatttgaggaaactatttgaaatattccttatatgttcttgacaagttgtatttaggaatttctctgttttcctttttcagtacttgaagcttttatttgaattactttttgcttacaaagtttaagacggagcttgaattttcagcttcatttaaaatcatgaagagaagtcttaagggagtatgtcgtcaacctgtggaatgttccactagagaattgcgattttctcttcatctttgaaactacatgtctaattccatgttattagacattccattaaaaatgcttcttattgactctagtgttcttttctgatgctcatgtttttttgctattttgaggaactcttctattcattcagttgtttaataagagtcgacaacatgccaagcactctgaaaggcactcaagattcagtggccaaaaacaggcacagttctgcatttcagagaacttacagtctagtgagacaacagaaatatcacccaaagaactggaaatttgcactctgataattagtgaaaggagtttatagttttatatatatatatatatatatagtgatatatcactatatataatccctatatatacaccatatatacatatgtatggcaggttcaattcaaactataggtcagtggttctcaacattgcctacacattagaatcagctaagaagcttttgaaaaataaaagtatttgactcatccttcataaactctgatttaattatcctagaccaggtcttggacatctgtgtattttaaaggaaatagaagagttcctttaaaatggaagagttcctcaaaatagcaaaaataaaataaaataaaataaaagcaagcatcagaaaagaacactagagtgaataagaagcatttttaatggaatgtctagtaacacggaattagacacgtagtttcaaagaagatgaagagaaaacctcaattctgtagtggaacattccacagggtgacactatatatatatatatatatatatatatcgctaaatatgcatatgggaaattttaatcagggagtttggggaaagtttctgaaggaagtgacagttaaatgataatttcagataaataggagttaatatacaggaggaattcaggtatcacaagatctgaaaaaaaaagtagtaagtaattttaacataatttggcagaatccatgagggttgtacatgttgcatgatctgggaagcgcataacaaaaagttatgtcaaaaatagtatgtttgaagtttacaaccttactaactttctactttgtcttatatttttctgacattcagctacgtatctatagatgtgactctgcagcagctggaatcacactccttctacaatttgagtaaagtgactcacatgtaagtacaaggaaaagtgcagcatagacctaagccacaaccactcttgactgataatcttggggctccagatggcaatgggagctggtttcttgattgtgagtcaaaacttctgtttatgattaaattattaacctgttctcattctcagttcatgttaattcatcttcattacacctcaattccatggttggaagttaaagacaacattaaaagttctgttcttgaaccactatctgttctattactactgtgtcagcatattttattgatgtgaatgtcagtgagacaataggtatttactgagtaactacttgattctatggtctgtgcaagattctacaaagctggcatattttccttaattcggaaagagaagagttgcttggtgagattagaatagtagggaatttaataaccctagttctggagttggtcagagttggatttgaacaccggcatctctgcctactcattatctacccttggacaagtcacataatctttcctagtctcatttgcaaaataagtgtaataagagctgcaacttcatgtttatcataaatatggaattatataatatctagcacctgaaaaccagtcaatataccattcaaaaatagaataatttttctatttcgctagtagattacaatctataaaaagtgttacataaataatcacattgcattattttaagtagctatgtattactaatcatgaactctattttcttgatgaagaaacaaaaatacttatctacaaatacttagtatatcctaacattacattaaacattgtatgaacattatttgtttggttattatttacctcttaaaacaaccctgtgaagtaaatacaattatttccattatttatataagaaaaacataaatgcagagagactaaatatgttttccttggtcgcacagttaccaagggacagggccacaatctttataccataaatgtatgacttaaaaattcttccctatccactacattaagatgctttcaagaatactgaggtccaagatattgcttacaagtatggtaggctaccttacatcagatcaactattggtctgagaataacttaaggagctgaatttttaaaaaaatgtttgaaagtattagagtgttatgaagacagtaagaactcaatgggcaataagcaaatcccaaaaacatcatttggttattttcccttgaggtatttcctgaattgtaagcaaaagcttaagggctaagaaactgaccagaggtttaggcatctattagggctaggaaaataaaactctgagttccgggcttgctaagaaggattgttcctagtaaacaatccaggattttggttgagatcactaaagagcttcatcctagaagtatgggaaaactgtgactagatcagcccttgcaaagactaaagcctagctttgaatcaataaaaaataactcgagtttgtggggcaaaaaaatcaagagaagaaaatagacaatagaaaatgatccataggaagttcaaatattggttatcagacacagactttaaaataactaacatgttcaaaaatttaaatggcaagagaaaatttcagaataaaactgaaaatgataagaaggatcagttgtaaactctagaatctaaaaagtcaataaaacatctaaatacatgagtttcacaagagattaggcatagctcaaaggagaattagtaatctggaagataggtcagaagactataatcagtctgaagcatggagagaaagagaaaataagaaatatatagcacaataaaaaatctagcatacctatgactagatcccaagaaaagagagaaagaatgagaaaagcaatatttgaaagcaactttccaaaactcttaagagacatcaagtcacgtatgttagaagtactgcaaaccccgaaaggataaatacgaagaaagctacatcgaggcacatcatagtaaaattgctaaaaaccaaagacgaaaagaaaattataaaagccagcaaggctgggcgcgctggctcatgcctgtaatcccagcattttagggggccaaggcaggcggatcacgaggttaggagattgagaccatccaggccaacatggtgaaaccttgtctctactaaaaacacaaaaatttgccgggcatggtggtgtgtccctgtaatcccagctactcgggaggctgaggcagggaatcacttgaacctgggcgggagaggttgcagtgagctgagattgtgccactacactccagcctgggcaacagagtaagattccatctcaaaaaaaaaaaaaaaaaaaaaaaaaagcagcaaggaaataataaataatactttcaaggatgtaacaagactgacagctgacttttcaacagaaatcatggaacttataaaacaacagaaagatatttgtgaacagcaaaacagcaaatatctgccaacccaaccaaaagattatttaaaattagaaaaagatagatacttcaagcaaacaaaaattgagagaatttattaccattaggctcatattaaaggaactactaatgggaattactaagacaaaaggaaagccatcccacatgctaagacatttctgtgcaggaagaaatgaaaagcaacagaaaaggtcaatatatgggtaaatataaatgaaccttgactgcacaaaatgaaataatgtcttaggggatttaaaatactgttctttgctctgcatgatagtgtgggatcataaaattgtgcagactgaaactgtattaagcagtcttaataatcaataagaaaaattgtgttgtgatttctaaaagcttttatgaaaacattaaaatttctcagtcagttataaatggaaagaaaaaataataaaactaatatttcacatactgtaattgtcaacattagaaatacttagaagtaaaatgctttattgctttgtaaaagcttagcaagagtagcttagacagtgcttgaccttttatctttattatataagttacaatagaatatcttttcaataccctggcaaattgtcatacttctttctaagtctagattagcttccatcattttatcctttgctttttaaatattataaaatattttcaagtgtttctttaatgtaaaatttttttaccgtcattgtttcttttgggacatcttcatcctttgcatccatttttctcccatcactaagttcctctgattaatatctagagtttctcagccagcctggacaacatagtgagatcttgtctctaccaaaaaaaaaattagctgagcatggtagtgcaaaccagtggtcccagctacatgggaggctgaggtgagaggattaattaagcccaggcattccaggctgcagtgagctatgatcacaccactgcattccagcttggatgacagagaaagagctggtctctaaaataaataaataaataaataaatagtctcagatggtggtggtatcaacattttcatgccagtgatttattctataactccatttacattttgtttgaatttccctttcagtaatattacatttcatttcttggcttcattttcatctttattggtaaattcactctttcaattagccatttttaggaaatgtcatatgaggtgattactgggaaacacataggaaacacaatgacatgctttattgtttgtgaatgaactgagcaagagatgcccagtgagcaaccatcaatgactttgaagagtgatgtagttggtcacctattataatgtgcatctgttatttacatagtgatttgtggactgaagagctagcaacaaagtttgtactttattcaatgattaatagttaatatactatggtaactgaaacttgagggatgtgttgaggacagttattatttacatttgattaaatcatggtaactgaacttcatgtgtattggagccattcaaagtagaactgcttgtatgcatagaattaaaatatgcagtagctttttaaaaaaagtataggacattataaataatgtgaaagtgttctaaaggtctttgaattatctgagaagtggtaaaagtactaactgaaattaaactttaataaatcataaataaatgttttaactcacagggcagctactaaaatgcttgtagaagactggataactaacaggctaatagtagtggggaatggaatgaaattaattaattaatacaaaaaagcgagaaattggaagaaatagagagtttctggaataaatagtagatttaactccaaataatcagcatttacattaactgcattaaatgtaaaaggactaaatactctaagtaaaatacaaagattgattgctgaatttttaatactcgctgtatgctgcttacaagagacattttaaacattatacagaaaggttgaaagtgaaaagctttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaataaaaaataaatatatatatatatatatatatatatataaaatgcacacagtaactaaaagaaaactgatgtaaatatgcatacatataaagcataaagtcttactctaagggacacttcataaagattaaaggaattactatataagatatagtgattctaaatttaatgtctataagagcatagcttcaaaccatataaagcagaaattggtagaactaaaaagataaacaataattggcaatcatactgagagcttattttaatatagttttatcaataattgatagaacaagcataccaaaatagtaaatatactgataaaaagttaataaaaagatttgaacataatttacaaacttgatcatattggcttataaaaaatattgtatccaacaactgcagagtatatattcttttcaaagacacatggaacatttactaaaattgaccacatgtggggccataaaagcaagtctcaatagattaccaaaaaaattaaaatcaccatgttctctaactagtaaataacctaacttctaaataactctgatttctaattaaccataggattaaggaagaaatcataataaacattagaaaataattttaactaaatgataataaaaatatgacatatcaaaacctgtgggatgtagtcaaagtcatacttagaagaaaacatatagccttaagacaacatatattagaaaagaaggttaaaaataaatcatttatgtatccttcataagaagtttatataatagagcagtacattaaaaccaaagaaagtaaaataacactgaggcccaggaaggctgaggatccagtacagtaaagacaacaacagtcttcaaaattgaaaaccaaatcttctgactccaaatctcatatccatttatcaaaccattttgcttctttgccccttcaccaaaaataaaagcaattaatttgtagtgaagtcctatataaaccccattgatcttaaaagcagtcattttgtttgtattatgatctttttcctcacaaagattccagttgttatttataagtttttttaagtaaacattcaattctctactctgagcaaaagtgttaacttcctaaaccgaaggaaactattaaatacagtaattaaaaagagaatgagtttaaaaataaattattaaaagataatttgcttatatacttgagatattgagagtctaatatcttaaagatttaaaggataatgcaccttgtattcttcaaatgtttctaatatgtatctgacattattgtctgcaaatggttttggtcagcagaaaagattagtgaagatttttgcatgcatgccacccaaatgtttaatacatttgttttataatcatttattaagcagcgactataatcaaagcattataacttgcatgagaaatatagagctgaaagatcactcatctttgctcaaggaattgagaatggttttgtgggtataaggcatgaaactgagtatcgatatagaatgatttgtttaatttatataccatataagtaccatcaaccaaacgttcctgggattcctcagtatagaattaaagccctctgatttgtttaggaaagagagctctttattgtgttggatttgctgcaaggatagatatgtagatactaaacttatgaatacacatttcaaatgccaatgcatattgccagcatttattgaaaagctccaatgaggactacagcagtaaaataacataatgttattccatttcataagtgtgttttctttctaagctgcccttcaaaactgactttttttggtcctgtgatttggtaaatagaaagatgagcagttagtttaccattgccacttctaattatccctgccagtacctgtccagtcttacagagctctatatacattctctgagatggcttcccaattcatgtttagattttgttctgtgatatgaattagagtattagaacataagcactctttagcctaaagctgcctccttgtaaatttggcctaaaggcctctctgtatgcagtgaactataacctaactggatatgtgaacagaccacagaccataatttacttttttaccaatcaccgagtttcagccagtcacaggcgaccaattgttcaaacagtgttcaaataaggcaaaagctaagctataaccaatctagctgcttctatacctcacttctgttttctgtatatcaccttgtttgcatccctcccagctccagaaattctctatcacacagcagcaccaaagtctctctgaacctattctggttagggggctgcccaattaatgaattattctttgctcaattaaactgttaaatttatgtaacattttcatcttaacagtactgacattgggtctgtgacctagaattgtcattcccaaaacaaaaagctattcattcaataaatacagtatgtttaacacagttaaacctgtgaccatggcatctttttttttcttttattattatactttaagttttagggtacatgtgcacattgtgcaggttagttacatatgtatacatgtgccatgctggtgtgctgcacccactaactcgtcatctagcattaggtatatctcccaatgctatccctcccccctccccccaccccacaatgtggagaaataggaacacttttacactgttggtgggactgtaaactagttcaaccattgtggaagtcagtgtggcgattcctcagggatctagaactagaaataccatttgacccagccatcccattactgagtatatacccaaaggactataaatcatgctgctataaagacacatgcacacgtatgtttattgtgacattattcacaatagcaaagacttggaaccaacccaaatgtccaacaatgatagactggattaagaaaatgtggcacatatacaccatgggatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaaggagatcacatggacacaggaaggggaacatcacactctgaagaccattgcatcttaaaaggctatatgcaagattcaaaatagtagatcattctgttcttattcatacctcttcccttggcctctgtgatatcacaatcctggttggactcctatcatgctggtcagtctttcctatcatcttttgctggctgcttccccttccccagctataattattgggctttcatatggcccaatcctgtgtagtcttctcttttcactctaacttctcctgctatgtgatcttatctaacaattcccaaatttatatatctagttcaggccctcattcttagtgttggtatatacctattggtctacttgacctctcttcccagacatcttacacatatctcacgttttatatccaaaactgacatcttgattgtcgtcctgaaatctactactcctgtgtatgttgagccaataaatgccaacttccttcatcctgatgcaaatcccaaatacctgagatgtatcactataccttctttcctcatcacccacttctactccttcaccatgtcctgttgattctactaccctaatatacagaaaatgtatcctcttcctctccactgccaccacccttatttaagccaccatcatctcttgtttgaactatgataattttatatcttaactggtattcccaattgatttcctctaattcagtatcttcacagcagccagaatgatttttcttgaataaaatccaagtatcttaacataaacagccaggcccacaagttcagctggttcctgcccacctctgcgttctcatcatgcttcactcctgcacacctgtgttctttggttttttgaacagtccaatatctttctcacctcagggtattcacatgcttttgcctctgcctagacatttatttctctctctctctctctttgcctagttaactctactgattattttttcagcctaattatgacctacacagagacacataccattcagcccacttctgcatctaagttagatccccatttgaatctatccttgaatgctttttggtttagaacttactaaaatttagtatgacaatgcagatgtttgataataataggtctctggaaggcaggatgctttgtgtgccattcacttacaccaagctgtgaggaaatcaaactaaaacaaaaaatgaaacaatgtattctgaacatgcattttaaaaataatggattggaagagtaggctagtctgaattcatgaaaaatctgattgacagaatgtttagtatatgtgtgtacacacacatattcatacatatatgtttagccaaccttaattgagcatttaccatatcccaagcactacactaattgctcaacacatatatactcatttaatcctcacgacaattctctaaagtagttactatcattttacagccaaagcaactgagattcaataactacatctttatatttaaaatgcatttcatgtaaacatcacagaattggatcttgcttttatatccagcctgaaaatctcagccttttagttggagtgtttaatccatgacatttattgtaattattgatatggttggatttcagtctaccattttcctatttgctttgtcttctctgttctttgttcctttatttctccttgtcttcttttggattaatctagttgtttttgcttttgtttattagtgttctattccattggctttttagtcctttgcaaattttttgtgattactcaagaaattatgacatgcatccttaacttatcacagtctacttagaaataatattatgttactccacatatcatgtaagaaccttttgaaattaaaattccatttaccttcttccatctttcatgctattgttgtcatatattttattcctatatatgttataaacctcataatacattattatgttaactttaaagattcaattaacttttacataatttgagtaaagaaaaaaatagtcatttatatacgttcaacatatttaatatttccagtgtccatgcccttctgtaggtccaattatttccctttagcccaaaaaacttttagtatttcactgtggttctactggcagcaaattttctgaggttttatttactgaaaatatattttaccttaatatttgaaaaacacttttgctgagtatagaattgtagcaaagccatttttgtttcagccttttgaaaatatccttcaatgtcttctggccttctttttttctgaggagtagtcgtatccgtgttattattctcctgtaagtaatgtgttttttcccctctggttacttgtaaaactttttctatatctttgcttttcaactgtttaatcataatatgcctaggtgagtttttttatatttaatctgcttaaggtttgccgaacttcgtggatttatgggttgctggttttgttaaatttggacatttttgtctactatttcaatagagtatgttagaagtgatacaatgccagttctagtcccagtctttaaaagaactggcagcttttactttatatccttggaaccctgaacaaccatgtaagacgtccaactgcactgatggagagaccgtgtgggaagatcctgagatcctgggatggagaaaagcctagctgagcctaaccttctagcaattcccatcaaaaagccaggcatgtaagcacacccttttggaccctccaaattgttccagacaccagctgaataacacccagtgatcctggtggaggctacagagagcagaaaatcacccagctcagcactgtctggcatcctgatccacaaaattgtgagctataataaaatgttattttaaccacttaatctggggtaatttgttatgcaacaataggtagccagaggaagtagcaattatatgtcagttaacaatgggtaaaggcattgaggatttgtaagaaaaaaatacaagaatggtaggttctctgtgagttattcaggatcctaagtggatacaaatcatttcccctgggtagtaacttcagcgaggatactgtttggaccgaaaagtatgcatgtaataaagatttatatctgcaaaatgatgaaacactggacacttccattttctattgtactttctctataagaaagtcaataacatacagattgctgctgttgttactcctaataataatagtgaccaagttctgaatgccttttgtgggccagcactccactaaaagtacttcacatacactatctcactagtttttaccaagcgttagtttctgctatgtcaaatgaagatggtaatacataccttgcagagctcttgccaaagttttcttagctaagacatttcaaagtgagaatttgaacccaaaagtgtctgcctccaaaaccactgcaatgccataaaatctctttaattaaaatatctgcaataattaaagaaaatgctggccaggcgtggtggcccacacctataatcccagcattttgggagactgaggcagaaggatggcttgagcccaggagtttgagaccagcctgggcggcagagtgagacatcatctctatgaaaaatattttttaaaattagctgggcacaatggcacttgcctatagtcccagcttctcaggaagttgaggcgggaggatcacttgagcctacaaggttgaggctgtagtgagtcatgatcgtgctacacactccagcctgggcaacagaatgagacccctagctcaaaagaaaaaaaaaaaaaaaagcaaagaaaaagaagtgctgccctcagaagaatgtttttacttttatgtgagtttttgggttttgtttgtttgtttgtttgtttgtttgtttttgagacggagtcttgctctgtcgcccaggctggagtgcagtggtgcaatctcagctcactgcaacctccgcctcctgggttcaagggattctcctgcctcagactcccaagtagctaggactacaggcgtgtgccaccatgcccagctaattttttgtatttttagtagagaaggggtttcaccatgttagccaggatggtctcaatctcttgacctcgtgatcctcctgcctcagcctcccaaagtcctgggattacaggtgtgagccaccgcacctggcctatgtgagttttttaaatcaaaaataagtgaaaaattttacaactgggataggtgaaatgtgtgacttatgccttatagtacaataagactatattttgctgatccactaagttgaatcaagtggatgcatcagaggtttcaaaatcaccagctttagcaccaatccttaaataatcatgaaagtagctgtatgcacctgccaggcaatttagagaatcacttctataatgttctatttttagtggaaaatctgctgataaatttaaattttcttcaatgtgctttaaaaatctgaatacttataaactctcctcaatatctcttatttttaatttctcaatacattaaaagatacatcaaatcatgaatattgccttttggttatagattatttctttcctccagttacatatggaatgttaataataattcattaataattatcaaagaattaagacttctctcattgaaaatcctcgataatgtaggaaataatttattctgtgaactttcatattatagattaatatgaaaagtaagtgctagtctaacagtcaaggctttagaaactaaggtctaatctataccaagagctttgacagacttttaacttttgacccagtaattccacttctataaattttccctaagaaaatagagtagtgaaaaaaagttaatgtaaaaagccatttgtttcggagttaattatttatattagagagaatttggaaaggacttaaatgcttagctaagagaatggtcaaatatgaaatactaagccaggcgcagaggcacgaacctttagtcacagctacttggagactgaggtgggaggattggttgaggtcagggatttgaggctgtagtgcactatgaccctgcctgtgaatagccactgcactccagcctgggcagcatagcatgaccctgacttataaagagaaaatctgttgctatagacaatttaatcacataagaaaagcttttgtcattatgttatttaaaatatatatgtatgtatgtatgtatatatatatacttaacagaacaaaatagtttttctctgtattatcaaatgatgagagtttttttttacatttaccagcttattataaaggatattacaaaagatagagatgaagattgcatagagtgaagtatgggggaggggcgcagagcttccgccccctcccttggcacaccaccctccaggaggatggtcagctgtcagaaagttcatttcctttttgtatgaatgtgtttcaaagttttttacaataaatatgtattacctctatagtcagatgaaattaactttttaaagatcactgtgcattaaacttgaaattaatacttgatgtcaagatacatcagtaatgtattatgtgatagaaccctgtcctaaaatgttaccttaaaattaatttacctatttattagtctcaggtttcacctagggattgtatagcacttaaaaaatttatagtaacaaaatgatggcttgggcaatatatacacatcttatttttaaaataaatagtaactatttccttataccacccagagtatgcagcaaagtgcacctaatagatgtccagtaattattcacttatattctaattaatctcttcccactctaaccacttgagtgagcaaacctagtcaaaatcaaggtgactgccttccatttttttgaactataggtgaggtgggaaattaaagaaaaataaaattaaaaagaaagagaaataagctttcctatattaagctgacttgtcccagaggcagcaacaggcacagcccagacccaggaaaagtcttgataatactatttaatgtgctctggagactctcccagcactccctcaacatagggagaagaaaaacaaattttcctttgttttatggaataagtttatagatacttgttctctgtcactagtgacttcaagtattctgttttatctaagaagtacaaagaaagtcataagaagcctgagtaggcctgaactacagctgcctgggcaccatagtgaaggttatgagataaaccagtgcaaggctctttagagcaaaacctagataatgaacatctaggttgcttggcaacggtcatgtgcaatcctgagtttgtcctgcctctgtatccctgctttcacaccactgtaaacttgcttcaagctagcccacccccttttgtgaaatgtgtataaaagtcaagtgctgtctttgttctaggcccagtctttggacattgagtctgctaagtccgagtgcactcaataataaagatatcgtcctgtatacaccccaaggtctctctctggtcctcctgatcccacaacacgggcatttaaaagtaaacgggaaaaaaattgaaaatcaaattgaaacaagagttaaaaagaagctggggactggtggagagctaggcttttggctaatattcttgttcaatttattgttttgggtaacaataaattggctgtggcagcttctcttctgacatcatctaactgagtcttcttggtttatgctggtctgaagtgttctcatccccatctaattttgcagatgaaatgcaaagtcggctttttgattgccctcaaattgtttcctggcttggcatgcttctcactcattaactggggcagtttagggtgtggggaaatatctccaagggtgagaagcacagtcaaatgccacgatccaatgcccgttgaataattgaggtaggaagggggacactaggaaaatggaaggaaattagtggttggaaaaaaaaaaagtcttccttaacagaagattttaagtgttttccccttcttctgttcctcattccctcgcctgagaactcccttctctcatcctgctgatttcccatatactctttgaggtgtggactcagggactgagtgcctgctgcaatgctagtcgtaacgggaaagccagatgtcctgtgctacgcttttattgagaattaatcaatgtttcttaggggaagaaaaaaaacccagaatgtagacatgtgattaagtgaacctaactgcatgctgaattattgatctgttgatttgtgaaaactgccattggacagcaatgttacacttttcatctaaatgtttatttcatttgaaatctaatgaaggagaattagacaatgaatatttacatatatttttagttctgctggatgatttccttgaaacctcatttaaaaaaaaaaaaaaggctgtatttgaagtcataagtcctagataaaggcccagtgttgctgctaagtgtataacaggagattattcacttgccctttcaaaacatgtctccatagttttgtctgcaaaatcaggatgatccttacctgcatcacacgagtcagttatgttgctccctcactaggaggaaattcacaccctccctcaggtgaaaaaaaagtacactgtttctttttaccctttaatcttctgtattaatttgtattcatgcttctgtgaagaaatacctgagactgggtaatttataaaggaaagaggtttcattgactcacggttctgcatggctggggaggcctcaggaaacttacaataatgacagaaggggaagcaaacaggttctttctcacatggcagcaggaaagagacatgcagagcaaagtggggtagatccccttataaaaccagcagatctcatgagaactcactcactatcacgagaacagcatgggggaagcaccctgtgatctaatcacctcccgcgaggtccctcccccaacacgtggggattacaatttggattacaattcaagatgagatttaggtccctctcccaacacatggagattacaactggggttacaattcaagatgagatttgggtggggacacagagccagaccatatcatcttccaaagctgaatttttctaatcaatacgctttaagagccttgcatatttccccaacaaagaaaaagagcctcgctccataaaacagcatacttaagcagcatatctggcacatattttaatgttattttttatagagaatatataaagctttacttttttgtttttaaagtttgagattttttgcatcctctttattacttttttttatttagataaaataaaaagtgaaaattccacattccttctttttaaacctatctgctagatgtgaccactatgaacagagtactctatatttttggaattttatttatgcttattagtttgggtaggtgaattactataagaaatagacaaaaatacagacatgtaacagcccttagtgagtgaggtttactgcttgctcatgggagagtactggatggatgagtgggagcacagagcagccaccttcaggcagtcactcagggcctcaggttgctggaggcacagccatcttcagctctggagggcatctccattcctagtgtgctgtattacaaacagcttttctttcttccaatgtctccagctttctggcagcatagctagcctcctgcacactcaggccataattgcttaactcaaaatggtgtgattcaaattcaccctcagaggcatgcttgaaggcattcaaatttgaacgcctctttcacccttctctgattagatgttcttttgtactcacttctgcccttcctttcttcctatctttgaataggttttactagttgcatttgcttcttatgttacctctctatttaatgattgattgattgattgagacagagtcttgctttttcgcccaggatggagtgcagtggcacaatctcagctcactgcaacctctgcctcctgcgttcaagcgattctcatgtcttggcctcccaaatagctggaattacagacataagccaccacacccggctaatttttgcatttttagtaaaaacagggtttcaccacgttgcccaggctggtcttgaactcctgacctcaactgatccacctgcctcggcctcccacctgtctcggcctcccaaagtgcttacaggcatgcgccaccacacccagctgttatctctcaccatttagctaaactactggcagtctacgaccactccaccccttctctgcttcaggagatacttttcaaaagtcacttgtgagcaagtggtaagctgttgccttacctcagaaagcagcttcttttccctgctgttttcttgtggggtctctcattcatctttctcctttgtagctcttacatttccttctagaaatcttctcctccttcatgtttccttctctctccttgctgcctctcccacatttctcctcttccagcctccatgtaagttgccagcctcatttaatcaactgttactagcagctgcatttcatttcccttttattctctaccttttcagctgacccaggtgggctgcattttctttcactctgacgttctcttagaccactcactcaggactactcgttcaacgacagtctcttgtggagcaattttccagactgcaaaccctgctcaatttccaaactcctgcatctagtttacatctgtttgtctctggcagtagttcaaaccctcctcccccaatggaaagctctggcaaggagtttattgctcaccctggaaagagagaaccacctcaacagagattgatagtctctagaggggcaaggtgggaaaattatgagattttggagtagggtggccaactgtcacactttgcccaagacagagggaattccaaggatatgggctttgcattttaaagccaggacaaaaaaatgaaagattgtataaagaggatctttccatgcagggtcttgtttaggtaaaaatcatgacataatagtttaggattagcatagtgaggatttggaagtgaggagttctaagatcttggggtataaactgttgatgctttctgttgaagcattgatggttctttgtttcaaaaactctctgtaatgaacaataaagcaatttgcctgggcaagagtctcctggaattgtagttatgttaatgaggacaatggaccagtaagggtatattattatagacagtaagctgtgtgtttagggaggagagaggtaggtgatttctgttctcagagttaactccatcctctcttttccaaggtctgtttcatattcagtgtccttagttgaaatgcctagttgaaaaaaccagagagttttttctaattttgcaagaatgtcacaacatctccagtcccaagtccctgatgtctcttctagctttcattgcacttatgaaaataacaataataaaagcattattttagagccctaactatgtggaggccaaacataaaatccctcatgaatattatttaatcctcacaaaagccccacaaaagaggtgttgttaattgttcctattttacagacaggaaaactatggctcaaagaggccaagaaacttgtccaaggtcatataatcagaagtggcagagccaagactctatttcgagtccatctgggctattcagaaataaaaaggagtgaactactaattcatgttacaacatggatgaacctcacagacattatgctaaatgaaagaaggcagacacaaaagactgcctgttatatgattccatttatatgaaatgtccagataaggcaaatttataaagaaagaaaactgatcagtggtttctaggcataaaggagcaagtggagactaactgcagatgggcctatggttacttttgtcattgacagaaatgttctaacctgtgatgatggtttcaaaatcatgtaatgttactaaaaatcattgaactgtatgcctacatacaatgtttgaagtttatggaatgtaaattctttttcaataaaactttaaaaattacagaggtcacattctaagctttctgactggtaccaccaatgactagatgctggttcttttaggtgccactcctaaggagaaatgctaaaggtttactgggttcttatatacttttcatgtaagcatagggaatgccttaaactcttttagccaatcaacctatgttgaatatgtttaatttaaccagtgagagttcatttctagcagttacttatttctctaatgctaactgtgcattcttgatcagcatttatataaacctaagtatgtaagttactgacacacgatattgcactatacatgcagaagtgtcttcgattgctgacatgacaaaataaacccaagtgaactgtgaagacttaccacttctgtacatctggtatggcaatgacagagccttactgtccatcttgctgtgctgtcgttcatcataaaattccctcatcctcccactccaacactcattgtcttggccagaatacttataaataataaagatatttgtcttcaactcctcaccaaatcattggagggatttttcttttttctctaaatgtaaaagaaaaaaaattctgatactacaattaagaacaatgtagcccataaattaaagtggacagaaaccaagccaacaatgcaaaagagctgagcagccattgggtccccgtgaggagacaggagtagtttgtcattgatgggacccctggcagctacagcccctggggtaccctgtggcgtaaatgcatatttttctcatgaacgtttgttaaaactgatttatgttgttttgtctttgataagaacagatacggatgcattatagtgactgtgttccttgtaacttatacagagaaattcggaataccaggaacttaacttacatagaccctgatgccctcaaagagctccccctcctaaagttcctgtaagtattaaatcctctcccatcctacttttctggggggagggggtcagatttaatgctgttgtctcccaggaatctccctagatgatgtggtccaggttcattttaatggtgtatagcctgggtcgggggcaaggtatcgggtgaaatgatccacatttttaaaacctattcaaaagtcagcacataatgctggaaccagagacctgctccaagaaacaggagggagaaaatgctatcatgtatatgtggtccttaaatgtagtatttcagaacaaaacaaaacaaaattctgagagccagttggtcaattttgtttgaaaatgggtatcacaacaatattattagagtggctgttacacaggaaaaaaaacccacaaagagtaaaatacacttccatggggagtggagggaaaacagaagggacaacagtttcaacctcccactccagcactcaaatgtccagcactcactgctttgctttgaaaacaccttatgagctaaccataagctccatgaatccagggaccacaacattttttttctctgttgaatctttactgcctagtacagagtaggcgctcagtacaaatgtgttcagtggatgtgtctgtatgacctcaggccccctggataccaggtggaagagtcctttttcctacttgcatgcattataaagattagaaaacaaagagtatgaagaagaaaattgttaaaaaaaacttaatcccaaaccccaaaataagcactattaacatttcagttcatcttcatccagaccttcaaaacaaacttatgttatcatagatattttatgagataagcccttaaggatgaatagagggtatcttgaacaagaatggggagatagaaaagaaatttagctggatggaatagcatgataaagacacaaatgtagggaaccacgcagcttctttggggaactaaaaatagttgcttttttttttttttttttgagatagagtcttgctctgttgccccaggctggagtgcagtggtgtgatcttggctcactgcaaccgccacttcctgcattcaagcgattctcctgcctcagcctcccgagtagctgggattacaggtgtgcaccaccatgcccagctaatttttgtatttttagtagagatggggtttcaccatgttggccaggctggtgtcgaactcctgacctcaggtgatccacccgcctcagcctcccaaagtgctgggactacaggcatgagccactgtgcctggccaatagttgtatattgaagaggtgggtgtgagagatgccaggggaatggaagacactgatgggatatgaagatgaaaggatgtctggaaagccatgaaagcttatgggacaagacaatcactcttcttatggactctgagtttcaaataatacaataaccctttgatgtgatgatcccccactatatgctctgtggggaacatacaggtttctaagacattgtccttgcctgtaatctagttgaggagatgtgtatgaaattgaaaagtgcctctcctacagaagaataatggaaagtgacgaaggagagacatatacagtgtttgggggttcaggtaattagagaagacatcagaaagaagacccacagcatggttttaagggacttgtttgagatttttgaagaatagaaagatcttgatccaagtatatggaccccacttgactcttggacctttttccctcctactgttcttcatgagcacctattgcaattgaactagttcgtttactgtatttcaaatataccttatggaatctcacctctctcctttgttatctggaatgtccctcccatttgctgattttgagacctctggctcctgctgcctcttcaaatcctatgccttcttctctagaaggagtcaagtctgaatttgcctcagaaggagtatcaatggatatagtttttctaccagaagaccttctctagagctttactgagtagtgtctagatctcactctatgctatgccaaattctcaaaaaaaaaaaaattctaattacattcaagtagctgcaacaaatgttaaaacaactaaatctgggaggcatcaggagcctgagaattcttgtattcatggtgttttatgcatgtcttttaatcttaacatttttctgtagatgatataaactacagaaggtaaagactttgtctttgattggtttccttccttttctggacactgtctttttttgagacagagtcgccctctgtcacccaggctggagtgcagtggcatgatctcggctcactgcaacctccacctcccaggttcaagtgattctcatgcctcagcctcccaagtagctgggattacaggcgcatgccaacacatgcagctaatttttgtatttttagtagagacagggtttcgccatgttaggctagtcttgaattcctggactcaagtgatccacctgccttggcctcccaaagtgttaggattataggcgtgagcccctgtgcccggctctctggacatatttttttaaatggtactgttataatggtactctcaggtcactgctgtaggaaagatattcttggcaaaataacagcataatatcatgtagagcttgaaagaggaagctggcttaaagtcatcatatcttcctgtcccatcttcttcttagcccttcactaacaaacacataattttttccaattaaacgagaaaatcacacacacacacacacgaaaactgaatttatatttctagtaaacccacttggttaaaacaatctccagagcattctaagccgagcagatgtattgacaccagtggactggattaaattattatgccttgagggaatatcatctcatccaaccatcagaacttgcccatagttactcagatatttagggaaggtgttgggagtttgactacaggttgtcttcagaacccatgctttcagctattacattattctccttcctatgtgttgatttttttacctaaattctatgcttttttttctctttttttcattaatttagtggcattttcaacactggacttaaaatgttccctgacctgaccaaagtttattccactgatatattctttatactgtaagtatgcacacatgccatgtttgacaatattttgtttgtcactgacaagaactagaatacagtcatgagggtaggttgaagataagtaaagcaattgtttcaaggagtaagcaatgatcaggtgtgactacactggcatgaagtaaggcaaggactgagaaataaccactggctttagcaatgtggtttgttggtgactctgccaagaacagttccagtggagtgctggttggagtgggctcaagagagacttgggtagacagaattagaaagagttaccataattaactcttttgagaggttttactattaaaaggagcagaaaatagctcagtaattgcaagatattgagtcaggagaaaagattttgtttgtgtgtttttgtttttaaatggaagaaattatgcaatgtttctttgccaatgggaatggttgaatagaaggaatatttgatgataactatgataccttatttttcatagagttttaatagttttttaaacactttcccacacatgacatttgctcctctcagccaccttataaggtgtaaaacaaagttactgcttttccatttatgaatgaggaaactgaggaatagaaacctcaagtgattttgtctgagcagtgtctcaaggaacagtcagaagtggtactcaaattactgcctgtgacctttgattggcacccatgtgccctttttcaaagctggtgacatgggtcagttgtcttactaattgtataggaatgaaaggacgtaaggcagagagaattacaagttgagtttgcattaaagagtcagcaaaatgtagaatgataagcttcaaactcttggggttttgctagaaaaaaaaattgatcatacttctttgttgcaaaagagctcagttcaaaatgtaagcaatcttccagaaactagaatggcgtagaaaggttctccaggagcctggcgaagtttggcaagtgaaggacattttagaaatactcattaaatgaaatcctttaatccttttatcctgaccttcttaaaggtccatgcatgtagaaaactctagttgttgtggacaaagtgttgcagattcgggagaagcctctcaaatccatctgcctaccccaagatgaggattaagtcagggacctccacccacacctaaagctctcacttaccccacatttgggctccaggtgcatgtcatctaggacagctctcaccacctcaccagacctctgagccactagcggttaagaagggtcagtgaaacttaaaaagaaataagattaagctatattgtgtcctgttatttaagtgcatatgcgcagcaagacccctgctgcagaaggaaagcattttttcattaagtgtttttgtccctctctcttgcagtgaaattacagacaacccttacatgacgtcaatccctgtgaatgcttttcagggactatgcaatgaaaccttgacactgtgagtattaccagttctactccctccatcaactaaattctattttgagccattttcatatgtttacagaccatccaagagccatactgccttatcatatatactctatagagtacaaagtgttttacacaattaaataatagtattgtcttatgggatggtactctgtagactacaaaacagtttaggtaacaagacaagaggattccattacggcagtggttggtacatttttcacgtgaagaaccagttaggcattacagaccatgcaacctctgtaggaactggtcaactctggcattgtgtggcaaaaaccgcagtactcaatatatacactaatgagcatgtctgtgttccaataaaactttatttatagaaagaggcagtggactagatttggcctgcaggccttatggaataatcatctgtatccaagtgtccccattctacagaagaagaactggggtttaagcaaattgaagtgacttacccaagatcactgagttaaaaaaaagtggtgccactaagaactttataaattctgcactcacacttttactcagtaatcacaaactgttattaagctcctgtaaggggatattacatagaaagcatagtgctgctataggtcagcatttttccagagcctgaatgggggcaaagccctttagatggtcaaaagtagatgcttaattagggatattcacaaaatgttctaaaggagaagatctaatagaggtataaaggataagttaattctccaagctggtagaaagttcctctctcattgtgtaagtcacaaagtagagttggagctacctctgcagggtctcctctctattttcaggaccactgcccaagttcaagcctggtgaagtttttgtctggattgtcaccccagtttcatttctctgctcacactaaagttggggtggaggtctttatcagatacaaacctgatcaaattactcaccagaaaaatggatccaagcttcatacagttcttctaaggggctattttctgagccattcctagtttatcagtttgggcccaatgaagttacctcaacttctgagagcaatggagcatttcagatgatccttctcatcacaacctggtgagcggtcccttgaaaagacaaaggaggctccttctcagtcataatttcttcttaccatgcagaaaaggcccaggctcttagcctgctcagctccaaacttcaaagccatttacttcctcagtaaagctttccattgcgccatatagtgctcatcataaggaaactcctacatgctaaacttctttatagaatattacctctaccccttgacaccatttctctaaaacccccatatctcaagcacccccctcaagtgaaagctcattgtcccacacctagcatagagcccagcatgtgtttctagaaacatctgagtgagggaagcccatatttcctaaaatatagaggagaggatggcatggattattcatgatcttttcagatgattatttctacattttggcaaaagtccttgcttcttcgaagctcaggctcaaaaaactatcaacttgaaaagacacatgttccaacaaccgactttgtacctgtattcctggtaggagaaagtttcagtcaaagtttgtaattcttttgtcttgcttcaccatgttcccttttcaaggccgatttgttcattaagaattctgtttaatatctgaaatgcaattcaaacaagtatttttaatgtccaggactctcaacaaatttaggaaaattaaaatgccatatgcacagttctcacatcttcataaaagagttctagtttagaaaaaatttacttatccacagagttttctcagccattgtgcttatattcctgggatattgcaatcctcacccaggacatgttagtagctggaattaaactcgctatgtaattatttaagatgaaacaaaaacaaacacatcaacaatgacaacaaagccacgagaatcttgctcagtttcccacaactatataggataaatccaagttttagaattctccttttatttatttatttttttaattttttttttttttttttttttttgagacagagtctcactctgtcacccagagctggagtgcaatggtgcgatctcggcttactgcaacctccgcctcccaggttcaagcaattctcctgcctcagcctcccgaatagctccttttaacatggtcacctaataagtgttcctcactttgttaaatatatagttatttgatcctctctgcaaccttttgattgggcattacatttatgtactaatttatcacatttttagagataaactgaggataagacaggttgagaaattctcaggatcatccagctattaagtggcagagccaggtctaattccaaatttgaactttcctgtgtgcttcttattgtgttcccaaggttcacatgtggtagattactgtggttttcaaggttcccttacaactgccactaggagttctcactagcagtgcctgagtgtggttatagctgtcttctcttatcttcatgccaataaccaccaataacctcttgcattcccatatagcccagaggtcccaaggctggggctccttctcctgcagaaaggggggctgcttttggtaggtggaaataattatatttgaggttggccaggcacagtggctcacgtctgtaatcccagcactttgggagaccgaggcaggcagatcacctgaagtcaagagtttgagaccagcctggccaacatggtgaaacccccatctctactgaaaaatacaaaaattagccagacctggtggcaggcgcctgtaatcccagctactcaggaggctgaggcaggagaattgcttgaacccgggagcagaggttgcagtaagcagagatcacgccactgcacttcagcctgggcaacagtgccagactccctgtcaaaaaaaaaaatcatatttgaagtcagggatcctaagtctcaacagtcctagaccaatgtgtttttggcaagtcaccctcatgtctcagtaacttcaataggaaatagaagtaataacatttcagactggctccctgaatcattaaatgaattaattagtcatagaaacacagcaacaagttaaaacattaacatttccagcccagtggttcacacctgtaatccccagtgtttcgggaggctgaggcaggcggatcacttgagcccagactagcctgggcaacatggtgaaacctcatctctacaacaaatacaaaaattagccaggcatggtggcacatgcctatagtcccaactgtttgagaggctgaggtgggaggatcgcttaagcccagggactcaaggctgcagtgagccgtgattgagccagtgtactccagcctgggtgacagagtgagagaccctgtctcaaaaaaaaaaaaaaaaaaatccataagaggacatggtctatctactttcttagattcatctatgaggtttaatttaattcagcccataacccttaaacatttaatctgtgataagctctgaggataaaaagatggataaaatacaaaggtgaaataacatttaaatattaatagaaaaataaaaacatacgcattcagatgaatgtctttcaaaatgtttatcttaagagactgcagctgctcctccactattgacattgggttaactattacctcaaatccctttttctgaatgtatgtggaatattcttttaaaatcttcaatggtaacaagtttgttactcaaagtaaatatgattctgagaaacaccttaaatttactaggagctaagtcaggagaatgggcattcaaactgagaaatattatcttgtttccaacaacttgtactggaaagttttcttgtgggatacatatgtgggacctgaaaaacctttatgtacatttatgacactgaagaaatatagtccaactctccagaaacaggccagcaccacttctcaccagtcactgatttctcttctctctgttggttgtaggaagctgtacaacaatggctttacttcagtccaaggatatgctttcaatgggacaaagctggatgctgtgtaagtcaagggtagccatgaaaactgtcactttcccttaccctaagaaccatccaatggggcagaatgctgttgagagataggttctaccagagcatcttccacgccagagttagtgtgaccaacatggaaatgaggtcaaggaacttggcaggggcccactttagtgggcgcttacgttagctccaatggtaagttccaaagcttttctccctggtgtgtgtgtgtgtgtgtgtgtgtgtgtgtaaatgttcatctattatgtacatgaagtaaaaggatatctttaatgaagcccaaagctgttcagaaaataaggtggtttctcttttagtcctttctgacatgtttttgggaaagatgtcagtttatatttgattcactcagaaatagctaaaaaatcatatccaacttttgccttttcaaaaaataaatagtgctgggaacagctgaaacagcaaacaatagactttgtgtttgatgtgttttataacactttttgagtatttctttacaaatgatatattttttctatttcacctttttctatttgttgtttttttcaaatttacctgctcatttttgctagtgtcttgttatgtattcatttttgtaattatattatttgtttcactttaaacatttcatacatagtaattttatgttccagaaatgatccctgcaaaatctgaaggccttatgacacaaaatctgttgcgtatggggcttctcaaaccttcctgggcatcagaccctctgagaggtcttatcaaaatacacagtctgattctgtagctctggatttggcctcgggattccatatttctaacaaactcccaggtgatgccgacactgctgttcatagaccacactttaagtagcaagggtgaggtcaataagctgtctaaccctatgcagtggctctggatggagaagaacactcatgtagattatgtgattttggttgatgttctggtttaggggttaggtggtaggttctggaacaattccatttttaaatggtaaatggtaaaaaggtgtttgaactcattacactgaggcaaggctccctgagttctgtttgaagtgaagtctcactctttgctggcttttgtgcttcataccagtctttatgaaatgaagagttacagtaccattctctcgattgtctggttgtggagtcataatggttcatttccattatttttttactacataattataggcaaagtctaaaaagactctatcgagtaaggtgatacttaccccctcaaatttatttacagaattggagagaccctccttccatcttaactttatgatactaacttcttacaatctttcatctacttttcaacatatttattagacacttgcaatgtaccaggccctgtgccattcactgggaaaacacagatgaacaggagccatgtgctccctgcccacactgagcgtacattctggtgggggtcagctcaagggcagcaacatcaaagggcaaagtacattagggagaagtgtacccaatccaaaatatgcatctcagatagaaaataactgaagcctaaatatcgaataacattgctttccttctttggagatacaagctagattttttctaggtttatcccattgttttttaaatcattattaaaattaatgttttagaaatgaattatcctatattccaggtttcaagttctttttctaatctagcattctggaaaggtggcatttgattttaatattgtatgaatttcaccaaatattttcctctttgattcaactattcctagaaagctatgactcttagggtaatgatcttcaaattcaaattttctatgaatggagtatggagagttcttaaaataatgaagatagtttgtaggtacttagggtataaagatttcagatgactatcacacagttctagacatagagtgcaccaaaagtttagttagcataaaggcaacaaagactcacattagcaggggcagggataggaggtagtaaggaaatcttcaaccagggaaaccaaagctgttaatatggctcctgaattcagtgtgttcacctgactcttgcctgaactagaactgcctttccagaatggtggattagagaaagaacctgaaacctgggatatagggtaattgatttctaaaacattaatttttccacaagcaaaagattttggagcccaagataagaatctatgcttcaaattaactgcctgtttttcctgccgtatttagtcattggaagatatgaccctcagacactatcaattatcatttattcaagatagagtataaaattcagaccttaaggtctacagagcaataattctcaacattagggagttttcaaagcactaatgcctaggttttgccgtcagacattctggatgtagcaggatcatggggatttaaaactctctccaagtgagtccaatacagagcaaaagtcaagaactactgctgtaaaatacattatcagtcttcttgtccaattgtcacgttttacatatgaagggaatgaagcccaacaagaacacatggctttttttttttaacgtggctgttttaatttgatagagcttcctagtggccaagtcaaagctgagacctgggtcccctggttcagaactctttccctgccctctgctgggattcatcatggctgacttaccagccatcaccaaggtgtgaacatccaactctggcaagtgcagcttgtttcttagccctgaagattgcttagacttcttagctcaatctattaaaggcgctaaacacagaagttaaaatatcttgatcctgaaaagaatgagatcatgtgagagaaagaaggcaactcaaaactcgaggcataatcaggagaagtttcagaggacaatcacatcaagaaacagtgttgttagtccacgagaacctgactttaccaatgctgcaaagccattcgtgagcttccagatgaagtctggtcggcgataacctgacaaaaatgctgggatgataaaacgttattcaagtcaaagaattggtattgaacttagtttacgtatattgactattttccctcaaaacatctcactcctcctcatgattggcctcctggtcatgtttagagaactctgcaaagacttcaagagattttcaaaagaggtcttcttcaatcaggaagtgttagtgtgctaagtggatctcagtgtaggtctagcagcttattatcttatgaccagccataaaattagacacagagtatcaaaggagtttagagacattttctattgaaaggatggaaaaacgaacaagtgaacaataatttctctttgagcttctcctcagcctttgtgataagagaagggatgggagagggggagctatgttcctttaaactatatttcttcaactctctttccatagtaaattaatgggtgttactttttaaaagaaatttatgatcttataaagttaaacaagatatataagtggacttttcagatcttctaataaaatcatctgaattattcatatcaaagagggggccttagtttgcagagcttctcaagcagttctcagttacaggagcatctctctggtctggtgttctacagacttttgaggggaataccgcctctgataggtaggaaaaaaatcaaggtgtttttctaccatcacacactcaatacaacagttttgacaccaaatgtttggaggcttttcccccacacaacaagtaatcaattctccaatgcacaccagctggatgtcctacaatttaactcagttctgatactctacctggagatagcatcagatccacaggttaagggctcagtcccacaagactgcctgctacttcagatgccagtcacagctcccaggttgtgtcctatgcttctgactgaccaattataaatcagggttcccccagtcccctcctcagttcagttaatttgctaaagcagctcacagaactcagggagacactttaaaggatattacaaaggagcagctgtgtggcaaagatgcatagggtgagaggtaggaaggagtgcagagcttccatgccctctctgggcacacaccctcccctcagctccacatgtgccttgaccaccttccagctacctggaagctcatccaaaccctctcctctctggctttgtatggaggtttcattacataggcttgatttattacatcactggccattggtgatcatctcaatcttttcagcccctgtctcctacctgaaggtgagaaggtggagctgaaagtccaaccctctaattatttattgatctttctggtgaccagccctcatcctgaagctatctagggattgacagtcaccagtcatctcatcagcatacaaaagacacttgtcactctggaaattccaagagttttaggagctgtgtgccaggaaacagataagaccaaatacatatttcacaatattacactactgaagaagaatctttcgatataccatctgcttgggaagcaggtaaatttaagaaggtttattcaagagatagctgtggagattctaagaactagtaaagatttcaaatgatcagatggccttctgaaattaaccctatggaaaaagtacgcaaagtcctcacttagcatcccagatagggtcttgaaaactacaacttgaaatacaaacaatgtataatgaaaccaattttaccataggctagttgatataaataggagttgagtttctatagcatatttctggtcacaaaaacaaccaaacttttgcataaggaccaaaatgcttctaatgttaaatatggaaacaaatatgagctatacatacatttaaggtaggttaataaaaacaagagaattatttgcccaattattccagttcaaggtcacaggtggccacagcctattccagaagctcagggcacaaggtgggagccaaccctgaacaggacgtcaccccaacatgggacacaatcacacataccaccacactcacttgaactggcaccatctagacacaccaagaaacctgatctgcacatctttggggtgtgggaggaaattggaatacctggagaaaacccacacagacatggggagtgtgtgcacacttcacataaacagtagccctggcctggaaaggattttattctcattaaaactaagcaggccgggtgtggtggctcatgtctgtaatcccagcactttgggaggctgaggcaggtggatcacaaagtcaggagatcgagaccatcctggctaacacggtgaaaccccgtctctactaaaaatacaaaaaaattagctgggcgtggtggcgggcgcctgtagtcccagctactcgggaggctgaggcaggagaatggtgtgaacccgggaggcggagcttgcagtgagccgagatcgcaccactgcactccagcctgggagactgagagagactccatctcagggaaaaaaaaaaaaaaaaactaaacaatagtgaatgagacaatattattagaggatctgctgtatatatagagactctccgtacgttcacaccagctttctcctcagaccatatcatggattctgtgggaggcttagctgacggcagagatattctgtcagtgacaatggattttcaattcactggtgccatgacttactgtctaactatcccttgaaacataggaaagaaatcagtgtactatttcacaatactttcttgacatttttatgttaagtattaaagttatttggaagagtttaacaaatgtggaaactatttctttgttaagaatcttttgtgtcttggtttctaaaagtctagatcaggggtcagcaaactttttctgggaaaagcccagatagcaaatatttggggccttatgggacatatggtcttagttgcactacttaagtctgcctttgtagtgtgaaagcagccatagacaatatataaacaaatgagcatggttatgttccaataaaactttatttacaaaaacaagggcaaggtaggatttgactggagggtcatagtttgtagacctctggataaaagtattcagtgaggatgaccattgtgtggcgaaatatgtactctgtttctctgaatttctggtaaaggttaaagggcaagcgtgggatcaagataaaaagtatctggattaaaatatttggcgttagaaagtacagatccaatcataatagaaaacaaatttttttaatcagtattttgaatccaagctggaaactgctcctgttataaaacaatgctccatcattctaccctaagtttctgactcctagtcaatagaaatttattctttcctagatttaagcacttcagtaaaaggtatcatgtaaatccagtgtaaaatcaaaatgatggttgtgataaggagccctgggactggaggaagacaaggattgagctataggtgaaggaaagaaaggtcaaggttccatggtaataataaaatagtattcacattgtgtttttaacatagggatgttgcttttggtgtcaatgctaattaagattttaaactaaggcaaacacatcaatctcctgtaattatcttaatagtgttcaaggatttcacatggcatgttagcaatttggtaatttctccagaagtttgtccaggtatcattaggttctcatttaaacaatgtgtcatccaaaagagcaatcatcccctatcattccacttcatgacaatttactgaaattagcagatcgacctcatttacactcattttttaaaatgtaactgaataatacaattacagccaagctggacaaattccacatcgagtgcaagtgctgatgcctcagcagcagtcaagcaattagttaggatttcatgaaaatgatggcagatgtgtaaaagcacattgtcctatgacttcctatggcgccaagaatgttgtcatcactcagaggtgaaattaataataatacaagcatcccttgctcaacagaagttgaactgtacttggtcacaagttaagtcacacattcattgtttggaatttcttttccatcctctttccacgcaatctgcgtggggatatgttgcttctcacagaatgtctgattctctgtatcacatttcctattgtcaaactctagtaactagctactatctgacagtaaacatttaggcaggaataaaaataccattttgatatgctaagagcccaccaatacactaattattatgaacagagtcaacagaattaatgtgctaattagcatcatgcattagctgattcgaagtaaaacaccacatcttggcacactgggaaaagacaatgatagagaatattataggattaagaaggctattatttatcatggggtaagtatttgaacagcttgtaggatatactctaaggctgacttttccctctgcctattgagagcttgagtattttctcacaggttactatttacaaacagctgtcctgatttctgctacaaaaggatttccatagagcaatccagcttctctttaaactaacatgagaggtaggcagggggtccctttaattttctgaattagcaacgctgtgggaggaaaacatggttccccacagaagtgttcccatgagagtctcacaacataatcaaggcccagcccaagttccccataaagggactgtggaggcacaggctgaaattccatcttggagctgcaatgtatcctaaaactccccagagagccaagttcagcagcaatagcaaattctcttgccacgacatcacactcctctctctggcatagatcacgtctttctaaacctggtatagagggtgcctctttctaggagtcacccaacaatcaggctttcattccttcctccagcaagtctttactgaatggccgctatgtgccacgagtgagtccaacagaaaagggcgtacataaacacacatatagtacacataatactgagtttgtcaatcgaatattttcctcagctcattcctcaccaccttcattttcctgactgcattggtcttccctaactgtgaactattcacaatcttaaatcagggcagggcttcttaactccatgtatggaaatctgacatctcttttctcagaagaacttcatttcttccaacaggttctcaaagaggaataagaccccaagcggtgaaaagctgttgaacacatagagatgtagccatgtctatcttatttttaaaggaaataccagttcttttctcataagccctttccagcatagatatttagaaaccctgactttcaaaaagtatttcctttcgtctcttactacaagccttttgagtctcttttaagctactttatgttcatcttctccttgcaagggatagtttttatcactcctctctaaaataatcattttctagagtaggttaaccagatagcctaccaagatttgtgactgatttatccaagctggttacaaatgtggatttcagaagaatcaaggtaagtcatggtcaaggaatcagtttaactagactgataatcccaggaaatgtcatgtgataaatgaggttgatggaagcactttcctggatatcaaggcttctgtatatgtatttcccctccccactgtcttgacttcagatggaaggcaagagcagcaagctgatgcaaggttgaaaagctaaatgaggcagccctcaaatctgctgaaggcagagtgatggtttcacttttaagcatctaattaactctaagaggtaaagtaccccaacagcagtgctggttttagagaacacagtctcctgaagtgtcagttcatctccgttcatcttggccagggctcctctgcatcctcctcctcccctcctggactctggctggcttttccagtctgaagtcttctgcagagtttctggtaaactgcaatgcttatcaaccaggctccttatcctcaggagtatattaaatatcagatgaaaacactgcagaattggacaagcaataatttagttttacaataatttctaatgattagaaagaacaagctgaatttcacttgcagcagttagagatgaagaggaaaaactgagatgagttcaccggctcttacttgattttcaacagcctgggaacagaatgtgatctgcaagctgcattgtccagagaatacaaaaagagatgcaagccagtgcagcccttgtactgaacttagttgtctttttacaaaatcatgctgttcaatatcttctctgcagttgtttttttttttcaaggtggattttgcccactctgggtgtcactgaccaaaggaattccatggacatagtgggttaaaggagagtcaaacaatgatcaagtggggattgtgattgaagccactgggaaggcacagattggctgctttagcatcttagccaggtctctgaatgcatttgagatttattgactctccctttgtcatacttaacaatgccctgaatactgggtgttctgccactaccagaagatgccaagtttgggctatacccttgaggtgtttgtaaaccagatgcctcaaaaatcactacctcaacaagaacagttggtcaaatgccaccacaccataagccaagtcttctattttttcactctttatgattttttctttaaagcaatcgtctgtgtcaccctaagagtttaacactgcccactttactgtcttgatgaaaaagtatgttgatttattttctactcattcacatattcatccaacaaatagttacagagatggtgaacttggcactgggtagacatagaactttcattctggctggggagacaaaaaataaagtaaacaaataaataaacaaggtaataattatggattgtgataatgctgtgaaagaaatagagagtgtatggaggcaaaatggtaatggctactttagattagctagttctcaatctctatttaagaagaaaattgggccggcacggtggctcatgcctgtaatcccagcactttgggaggccgagttgggcagatcagttgaggtcaggagctcgaaaccagcctggccaacatggtgaaaccctgtctctactaaaaatacaaaaattagtcaggcatgatggcgatcgcctgtagtcccagttactcaggaggctgaggcaggacaatcgcttgaacccaggaggttgcagtgagcagagatcgtgccactgcattccatactgggcgacagagtgagactccatctcaaaaaaaaaaaaaaaaagaagaagaagaaaattgaaagacccaaaaatatataccaatttatgacatgtcattttgtggagtctcagcacttactcgtcatttagtgattccctcatcctgcccagaaaggagagatttcttcagcactggtgattggtaaaactcttcttcctcccacggtttcaacgaagactcatgcctgggtccagttaaccaggagggaagtttctctgtgagggctctggagaagaaatccttccgactgaaggcttaatattattattaaccattacccttaaaaatgttccaccatgaagagcaaaccccgtaagtagaataatggaagcattagccatatctaagcagaccttctgagggtctctgctatattcttttgcatcaacaggtggccactcactaatgtttaagtggaccaggttatgttgtgagttattctaaatgtgtaaattgggagcatttgtaacaaggatatatatatgtgctatgcttctttttagataattttgttgtgtaataaagttatggggaaacagccagtttcaaaatccttggaagcttttatccatttggagggaattttatttcaaaatcactttgtaacttaaattgctccaaaaacattttaccctctaatgcccagtgtgtttttaaaatggaatggccaatgtgcccaccaaacctcttccatggaaggttgatgagattactctgtaatctcatctggctaaacactgctcacacacacactattgggttgtcagatcaaatacaggccacccaatacaatttgaatttcagatcaacaacagacaacttttaatataaatattttttaaattgcatggcaaatatttttactaaaaaattattcattgtttatctgaaactcaaatttaactggcatcttgtatttttatttgctaaatctgacaactttacccaaagaaaacatctgaatctctgacagtcctcagcatctctcaccaccctcaccatcttcattccattcctaatttaagcctagtcttcaaagttaaattggaatataaattaatactaacaaacaaaatttggtattacagaggattggcattaaagagaattaaaaaatacagttgccactggcctgaaaaatagggaattaaaacaacttttaagaaatttaggtatgcaaactagatcataaacatgctcattttcaaaaacttctgccataattaatgtgtaaaactttatacaattgaaacctagaatgttttaagtgctcaagccagaagaagataaagtatcttctaaattcttgaaatcagtcaatactatggtcacattttattctgatatttgtactaatttgatgtgatttcttaaaatcacctaattcattctctctctctctttctctctctccctctagttacctaaacaagaataaatacctgacagttattgacaaagatgcatttggaggagtatacagtggaccaagcttgctgtgagtaagacatacaaaagaatattttagtctttttttttctttttttttttttggaataaatggagacattaaggggagaatcttatgttcaagggtagaaaatgttgctgtctcgggtaaaggcttctgcaagtccctcttttcctggctgtataggctacctcttggaagaaagtccttgtcctttgagactcagaaggccccacgctccagtatgccatcatgatgcctgctaaggcagccaccttggtgtacatgctcacagaggctctgttcatggagcagctgctgtttgaaaaattttgaaatgcaagatccacaactagatggaaggcactctagtctttgcagaaaaaaatgtacctgaatgtacattgcacaatgcctggcacaaagaaggaagaatataaatgatagttcgactcgtctgtggaagaacttacaatcatggggaaagatggaataaaaacattttttaaacagcatgaaaacatacctatttgtgcatttcctttgatttacacccccacatccaatcagtgatcaggttctattgattctgcttccctgaagcctctgtatcattgccaccttcctcattcccttggttttgcctcagtttagaatctcatcattgagcatccactctagtccttgccaaagtggatcacaggccgggcacagtgtctcacacctgtaatcccagcactttgggaggccgaggcgggcagatcacgaggtcaggcgatcgagaccatcctggctaacatggtgaaaccctgtctccactaaaaatacaaaaaattagctgggcgtagtggcgggtgcctgtagtcccagctacttgggaggccgaggcaggagaatggcatgaacccaggaggaggagcttgcagcgagcccagatcgtgccactgcactccagcctggacgacagagcgagagtctgtctcaaaaaacaacaaaaacaaaaacaaaacaaaacaaaaaaacaaagtggaacacagcaccgtagagatacacaagataatctgttaggggcgagaggaaatattagaggttctatttatacttatttttaaataagaacaaattaagttttattaatcttttatttatagatagccactgtccctcaggtgtcaggtaggggtggatgcctcctagagaagggtgagtgatccacagtcctgagcactggataccttcactctttcacctttaacaatgttatttcactttcagactgaatgcacccagtgcatttaaggtcctgttctcttaacacatacgctccatccaaataagaggtcagagtgatcttgaaaatctgctgtgccacgtgggggttactgttaattcatggcaaagtacttaaaattattatgcatttttctttttacaagaagacaagtggggaaaaaatgtattaaccttttctgtgataaagtccctgtcagtaatttttaacctggaagatatttttcaataacacttttatatctgcttcttcaagattaaggtactacttcgccaagtaataagaaaagtcattgctttttcaaagaaatgtatgctttagagaaaggctttagaaacaggtatttggaaatattcacatattatgcgattttcctgataaaaaattgtcaatgccataaaaattctgtttggttcaaatcagaaatagaattttaacttgtttttaaatctttcaaattaagtttgttatgaactaaattgtatctgtcttcctaaattcaaatgctgaagccttaacctctagcatcttagtatgtgactgtatttgaagatagggtctgtaaagaggtaattaaattaaaataaggctgttaggtgagccctaatccaatctgacaggtggcctcataagacaaggagattgggatacacagagagacaccagggatgggcgctcacagaggaaaggccacgtgaggccacagcaagaaggtggccatctgcaagccagggagagaggcctcaggagaagccaaacttgctgacactttgatcttggacttgcagcctccagaactgtaagaaaatacatttctgttgtttaaatcagccaatctgtggtattttgttaccatagctctagcaaagtaatacagagttgtagcaggtttaaaatccatgtgtataaaatgtgaaaatgaaacacctccagatcaccttgcaaaaacaactgattgacatcagaaaatataaaatttcattaaaaacatgtatttaattactgaattagattgaaaaatgagaatcttagtttaataaatgcagttaagcctgctctattcttggtgaaacacccatctttggtaattttttcaactaggacggccatttaaaccaaaatcaaaataaactgaaccaaaagcagactttgaacagccatagccaaaagggttaaaaataattttcaaaactaattaagcatatttgataacattgcttttgcttttatgaaactttaaaaaatatatattacttatcttcattgcattattttaaaatgtatgtttagtgtgttatggtatatattatatagtattacaaaaatacatgtatagggttcatgactgttcatatgttagtggtacatactcagatattttttacttattaatatgtgagattgaaagaatttgaagaccaatagtgtagaccagaaccactcaaagtgagttcattacaaggtaagtggctgtccaggatatacagcaaagcacagcttcttttttggagaaaatcttgtcatgaaaataaagtcaaccaaactcaacagtgtgtttagttgaagtagctggcttacatccagcatacgcttcttatccttggaatggtaagaagctattggccaatgggcaccatacgttgagtagcagtagtctagatgattagcgtctccaaatctggctcctgcctttatttagtcttggttcctctcaaatccaccctccccaaacctctttgggttcacatgcaaatagaatcttaaacccaatactggcctcccattcccctcaggatagaggtcttggtgtggcttgcaaggcattgccataatcttcagctttgtcttttacactactttacgcctctgatcaatggtccatccatatcgaacctcttagctcccttaattctccaacctacttacactgttatgctaaactcttactcttcctactgtctggaaaaccctgctataatcttgtctttctgatgagcacctgctggcattttaattctgccttagagggcagaattgtatttccacaattctggttcatattataatgcccaaaacacagtatgagcttaataaatatttgtgaaattaatatggtacccaataaataattaaagcactcttctgtaaacattatagcacttaaagagcaatcatattttaaagatattttagtctgttgtcctcaagggaatgtgtccatttctacttctttggaagtggtcaattaaactacctgcttgtactgcctcgaagttgttttttatatttatggcaagattttctacaagactctcccaccaagttaagaggatttgtgaaactgcctgaaaatgctttccctgcctcttggtggcattccaggttgtggaaagtgacaaagatgaggagttatacctggagttgactcccagccccatcacttactaactgtaagacccaagtctcagttttctcatctgtcgaaacaggataaagtaagctaataaagtttaaataagataataaaggaactaaatatatcctcaataatgttagacattattatgattattttcacttcttcctgaactttgacacttcattattctgatctgttgtaacctctctgatcactccttccccatttctctccttagctcactgcatcattcctcaaaatggggttccatcctgggtcctggctctttttcctctatatcttctcctttggttaaatcatctgctcacaagtatcatgagaatgtgaatgatttctaagtttagggcctcataccttagctcttatttggccattcacccagctgaaattcttttcttgctccctctcattcctatccaatcccaacaatctggttaaactctccctagccagcctttgaaaatgtacaataagcatttactgatgagaacttgctaagcttgggattcttcactgggaactaccagtaggggagggtcactacattaaagaacagtgagtgaaaagcctcatcaagaaggtggcaattcagaaaatatctgaaagaaacaaagggacaagcctggggacaatctgaagaaagagcattttagacaagtgcaaagacccccaggtgagaatatacctggcacgtttgaggaatagcaaggaggccattgccgctcaaacagagtaaagtaaacgggggaaaaagtaaaagctgtgatcaaaaagatgatagggttgaggagcaacttgcagatggtcttagaggccatcatcaggtcttttgatttgctctttagatagaggggaagccataggagcattttgagcataggtgtgtcacagtctgactcaaagtttcacaggaacatgccggctgttgtgttgaaaataaactgtagggaaccaagtatggaagcaagaagaccacttaggaatatgccaaaataatataggcatgagatgaaagtagtttgcactaagacagcagcagtagagatgatgagaaataatctgatcctgactatattttttaaggtaaagccaacaggacatgctgatggatcggatatagcagatgatgagagaaacgaaggaatcaaggagaactgtaattatttttgactgagcagttaggagaatgagatcactatttcctgagataggggaagttagtttgaggtcccatgatgcatgcaggcaggcagtgatatatgtgggttcaaaagtcacaataggggtcagggctagagatatatttgagactctttggaatgtagctggtgatgaggggatacaggtatagaagaaatctcaaaaaatgaatagaattgagacttctgaactttccccaccaatgtgatttccctgatctttttttaaacaacattaaaatgacagtacttctgagaaaatataaatacattaaaaagcatgtatttttaatgacaaagagtaggaaaggtgatcatgtgagtaaatgatgaatgtcttcaaaaaccaagagagagctgcacgctaagtacttgcatgggtgaaatcaataaaatgcaagctaattcaaatcacaaaatctaggaaatattttatcaattaaatcttaagtgttctgcaaatgagaatataggtgacactgaagctggtcagtctcattctgcacagtcaagcactacttcttactcatcccagaaaaaagactagaattttctttctgttaaaatgtcatcaccaagactcaaggagaataagcacagttggggttagaaggcaggtactgttctgaaaacaggattatatgaaaatttacattctaaaatgtaagaataacaatcctcttatccactcactcaactcatagaatattggcaaaatgtataccttccaagtaagagatgagagtactgaggaagctgacaggcccaaggaaaagaaaaaaaaaaaaaacctacaaaaagtatcactgggggggaggagccaagatggccgaataggaacagctccggtctacagctcccagcgtcagcgacgcagaagacgggtgatttctgcatttccatctgaggtaccaggttcatctcactagggagtgccagacagtgggcacaggtcagtgggtgcgtgcactgtgcgcgagccaaagcagggcgaggcattgcctcactccagaagcgcaagcggtcagggagttccctttcctagtcaaagaaaggggtgacagacggcaactggaaaatcgggtcgctcccacccgaatactgcgcttttccgacgggcttaaaaaacggcgcaccacgagattatatcccgcacctggctcggagggtcctacgcccacggagtctccctgattgctagcacagcagtctgagatcaaactgcaaggcggcagcgaggctgggggaggggcgcccaccattgcacaggcgtgcttaggtaaacaaagcagcagggaagctcgaactgggtggagcccaccacagctcaaggaggcctgcctgcctctgtaggctccacctctgggggcagggcacagacaaacaaaaagacagcagtaacctccgcagacttaaatgtccctgtctgacagctttgaagagagccgtggttctaccagcacgcagctggagatctgagaacaggcagactgcctcctcaagtgggtccctgacccctgacccccgagcagcctaactgggaggcaccccccagcaggggcacactgacacctcacatggcagggtactccaacagacctgcagctgagggtcctgtctgttagaaggaaaactaacaaacagaaaggacatccacaccaaaaacccgtctgtacatcaccatcatcaaagaccaaaagtagataaaaccacaaagatggggaaaaaacagaacagaaaaactggaaactctaaaaagcagagtgcctctcctcctccaaaggaacgcagttcctcaccagcaacggaacaaagctggacggagaatgactttgacgagctgagagaagaaggcttcagacgatcaaattactctgagctacaggaggacattcaaaccaaaggcaaagaagttgaaaactttgaaaaaaatttagaagaatgtataacgagaataaccaatacagagaagtgcttaaaggagctgatggagctgaagaccaaggctcgagaactacatgaagaatgcagaagcctcaggagccgatgtgatcaactggaagaaagggtatcagcgatggaagatgaaatgaatgaaatgaagcgagaagggaagtttagagaaaaaagaatgaaaagaaatgagcaaagcctccaagaaatatgggactatgtgaaaagaccaaatctacatctgattggtgtacctgaaagtgatgtggagaatggaaccaagttggaaaacactctgcaggatattatccaggagaaattccccaatatagcaaggcaggccaacgttcagattcaggaaatacagagaatgccacaaagatactcctcgagaagagcaactccaagacacataattgtcagattcaccaaagttgaaatgaaggaaaaaatgtgaagggcagccagagagaaaggtcgggttaccctcaaagggaagcccatcagactaacagtggatctctcggcagaaaccctacaagccagaagagagtgggggccaatattcaacattcttcaagaaaagaattttcaacccagaatttcatatccagccaaactaagcttcataagtgaaggagaaataaaatgctttacagacaagcaaatgctgagagattttctcaccaccaggcctgccctaaaggagctcctgaaggaagcgctaaacatggaaaggaacaaccggtaccagccgctgcaaaatcatgccaaaatgtaaagaccatcgagactaggaagaaactgcatcaactgacgagcaaaataaccagctaacatcagaatgacaggatcaaattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccaatgtcaacattagacagatcaacgagacagaaagttaacaaggatacccaggaattgaactcagctctgcaccaagcggacctaatagacatctacagaactctccaccccaaatcaacagaatatacattttttttcagcaccacaccacacctattccaaaattgaccacatacttggaagtaaagttctcctcagcaaatgtaaaagaacacaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaatagatagaccactagcaagactactaaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggagctgaaattgtggcaataatcaatagcttaccaaccaaagagtccagatggattcacagccgaattctaccagaggtacaaggaggaaatggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaatgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattagacaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaatccactgctcaaggaaataaaagaggatacaaacaaatggaagaacattccatgctcatgggtaggaagaatcaatattgtgaaaatggtcatactgcccaaggtaatttatagattcaatgccatccccatcaagctaccaatgactttcgtcacagaattggaaaaaaactacttaaaagttcatatggaaccaaaaaagagcccgcatcgccaagtgaatcctaagccaaaagaacaaagctggaggcatcacactacctgatttcaaactatactacaaggctacagtaagcaaaacagcatggtactggtaccaaaacagagatatagatcaatggaacagaacagagccctcagaaataatgccgcatgtctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacccactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgttcatcatcactggccatcagagaaatgcaaatcaaaaccacattgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggcaattcctcagggatctagaactagaaataccatttgacccagccatcccattactgggtatatacccaaaggactataaatcatgctgctataaagacacgtgcacacgtatgtttattgcggcactattcacaatagcaaagacttggaaccaacccaaatgtccagcaaggatagactggattaagaaaatgtggtacatatacgccatggaattctatgcagccataaaaaatgatgagttcatgtcccttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataataataaaaaaaataaaaaaataaaaaagaatcactgatagtctcccaaagtcaccatggtaatgcccaccagccaataagcttccacacacagagcttcccataggcctcccttacaaacaagaacagacatccaagaaccagcagaccttcgaggaaatccattgacatgaaaaacgtcaatgtcttagagttttcagtgtacagatctttcacctccttggtttaaatttattcctagtttttgttttgttttgatgccattataaatgggattgttttctttgtttctttttctgatagcttattgtttgtttatagaaacacaactgatttttgtaggttgactttgtatcctgtaactttactgaattcatttcttagttctaacaggtttttggtggaggctttctgattttctgtataagataatgtcatccgcactcagaaacagtttctcttctttctttaggatttggatgccgtttatttgtattgcctaattgttctaactaggacttccagtactatgttgaatagatgtggtgacatgaaaaacaaggactaaaataaacagaaaaaggaacttggaaggaacagaaacaatgcaagaaccagaagaaaactttcatgaaagttataacaaatatcctcagagagacaatgttttacatgtgcaaaacaattccttatacaggaatattcagaaaacaataaaagagcttttgaaaattaaaaacatgaaagccaaaaccaaaaaagtaagcagaagttgttaaagataaagggaaaaatggcactcagtagagacagcaaaaaaatatgaaatagaggaaagaaaaaacatgaacattagaaattcaagccacgaggtccacaacccaactaacaaaagttttaggaagagaaaacaaaaactgaaaaatagtgtagcagatttcccattaataaagaaaatgaattttcagaataaaaagacccacggagaacccatatggcaaaaaaaaagggtggggaggcatgaaggtacatcataaaacatgaaatcaatgggataaaaataataaattaaaggcgtctagacagagaaatcatgtggcctgtgcaggtgggagaatcggaatgccctcagccttctcaatggcgacattgaagaagaccatagatagaatacacctgttgaattctgaagggaaagtcatttccaaactaccaatcaagtatgattgataaaataaagatattttctcacatgcaaaatctcaaaaccttgatttcctgttcaccttttcttggagaataaaccaggaaaaagaaaaatgaggactttgttaaaacagtgatcaacacaggaaagaagcaaatagaatccccaggatgaccacaaagggaggtctgaggaatcttgggaacatgatgtctacatcagagctgaagaatgaagactccaagaggaaggtcttctagaaataaaagagggttggctgggcacggtgtatcatgcctgtaatcccagcactctggaagacagaagcaggcggatcacttgaggtcgggagtttgaggtcggcttagccaacatggtgaaactccatctctactaaaaatacaaaaattagccaggcatgttggtgcataattgtagtcccagctacttgggaggctgaggtaggagaatcgtttgaacccaggaggcggaggctgcaagtgagccgagattgcaccactgcactccagcctgggagacagagcaagactctgtctcaaaaaaataaaaggattgatagattatttgatggaattcattgtgtgaaaaactggtttgagatgtgttttcttttcctttttttttttttttttttttttttttttttttttttttttgagacgaagtcttgctctgtcacccaggctggagtgcaatggtgcgatctcagctcactgcaatctccacctcccgggttcaagcaattctcctgcctcagcctcccaagtagctgggattacaggtgccaacaccatacctggctaatttttgtatttttagtagagatggggtttcaccatgttggccaggctggtctcgaactcttgacctcaggcgatccacctgcctaggcctaccaaagttctgggattataggtgtgagccaccgctcctggccttgagaggtgttttaaagaacattggagcatgtagaaaacttagcaagaggtttgttcaaacaaagacacccaaataaaaagagagagacagatggacatcttatgaaaaaaaaaacaaacagttacatgacaaaggaaatgaaagcgcaatatgcaaagttgcaataaccacagtactgaatatgggtttaaccaaatatgtcacaaaactatttcaggagagtagaagagtgtgtcaggagaggaaatgtgtaggggtgagggatgataaaagaaagccaaatcctcatcttctatagtagagagttagcggataaaacctaaaaacaatacatcaagaaatacttacacttatggaaggaaataccagaagttaaaaggggttacttctgggacatcagacaccagactgcagggaagggctgcctcttgtattaacaagcttccagtataatttgctttttaaaaataggtccatgcattattttaataaaaattaggctgggcgtggtggctcaggcctgtaatcccagcactttgggaggctgaggcggtgtggatcacttgaggtcaggagttcaagaccagcctggcctacatggtgaaacgccgtctctactgaaaaatacaaaaattagctaggcgcggtggcaggcgcctgtaatcccagctactcgggaggttgaggcacgagaatcgcttgaacctgggaagcagaggttgcagtgagccgagattgcaccattgtactgtagcctgggagacagagcaagactccgtctaagaaaaaaaaaaaaattaacacttaatttaataacaaagccacaaagcataggaagagaagacaatggagatgtcagcatgtgagaggtcaataggagaaaagtaagaaatgaacaaagaagagtccagtctcattcctgaacttccaagcatagttgttgtctgaaaatgaatttgttaactaatcatacatagacatgtgatgtctctttaattcttgtcttgatcttttgtcaaaatctccattattttttcccacatagcttctttccataattagattttaagatcccagaggaaataagtggtgtcttatactttttataaccttcctgtatcaaaacagaagacagaaagtgctcaataaatattggatgaattgtaactaaatatcaaatagccatgatttcattgtcatttgttgtcaaagccaaacttcaaaaatcgtaaactccatctaaagaaaagagaatcagatgccatatatatttctgccttataaaggtttttgagggagaatacagtcacgtctaatagtctaaaaagtcaaacttacccacttaatcattgtttttcaaggtcacttctcaaaagataatctaatttaaagcaggtgcaatatctagagtcagaggatctattatccaatatttgctgtttttcaaaaagacttataaatttagtttggaagtataataaggttttttattgattgatttttaatcaagatatgcaatctcattttccatttttatactttccatttttgattaccttgttttctttttatcttattttgaaagagaagtgcttggtgttttaaatctcagaggaaagaacacactgaaatgcaatgcctttcataataatcagagttctctaaattctaaattatgtaacccactttaatatagcatttagcatattgttgagtaagtacctcctaagaagaggaaatctctgtaataatatccttgagttttcattacaggtatcagcataaataaacttcaaaaacacacttttcttgtttttagctgatcaaattaatacaagggtcatggcactgtcatatttctttggtttcttttttttcttttttttttaaactcttcatgatcttcacaagataatactattaggtggctgaaaatttgtggcagagtccttaccggcatgcctgaaagacacaggtgaatacacgattttctaggatgatcctgagcaaacatatattttaaatataatttgcatacaataacgtacacaattttttaagtgtacaggttgatgcaattcgacaaaactatattactctagcctgattaagacttggaacattttcattatccagaaagttccctcatgcctcaccccacctcccatagacatgctatttttctaatataaaaatttagtagtaaaattaacaggtaataggatagatttatatctctatatatatgtctttatgtatactttataggaaatactgctatactgttttccaaaagggttgtctcattttctattctcaccagcaaggtatgagcattttatactggccaatgcttttaattgtcatttttttttattctagccattctaatgggtctctcattgtggttttaatttgtgtttccctgattattaatgatgttgagcatctttttatgcacttgtcagctatttgtatattttcttttacccagtttctgttcaaattttttgcccattttcattggatttttgtttttttattattcaattgtgttccaggataaaatttttgacctaaataaaattttggtcctggccaccagctctctgccaaccctagtgcaaatggtccatttactcacttattccacagccattttactaagcacctactgagctccagtagttataaggataagacacagcctctgctttaaaaaggttacagtcaaatttaggagaaatgtgaataagtaactgtaacataagtttaatgtaaaaagccataggagatatttagagactgaacatgccatttctagttagggtgatcagcaaaagctttattaaaggagatagtatttgagatgggcttcaggtgaggagcagaattgcaacagacagtgatagagttatgagagaaaacaaaggcatgtctataggaaaacatgggatgtgttcagaggaaaaaaaattacataattcaggcaaaaggatagtgttgggatgttgtgttgaaatcatattatggacaacctaatctgacgcagcaggtaaagatggtccctgtggaagtagtagtaatagttgcataacagattaaagtttgtggccctcaactcgcctcagccctgactatattattgctgatacctctgtcacagccactgagctgggactgctaatctgcacctcctggcaatttgacagggactggatctccctctgaggggagggaaattgagccccaaatacctcatcagcctggagctccttgactttctttctgtgcttaccaagtgaagctcttggtgcagctcccttggagaagggaacctcctgcagatgcaaagccaggggaggcttgcatgctaggctgccctgctcaccgactgtgaaatgagttgcaaacacaagacaaactgccgtcttgcacacctagcttgggcaccaagccagacccatgccaaaggagccgagttgttggggaagcaactgaagtaggtcatccctcctaagtcacacgctcacatctccagaggcacagcaaagggtctgcaaggaagatcatgaaagaatttgaagagagagagagtaggcaatgatctttccagaatggtgtgcatgctgacttcttgacaagaacagggaatggtctgcttcagccctaggaattttcagaacagaagagtcacattgacaactcaggatacttggtttcccccaaaatcctaatttattgattggtagcatctcctactaccacagccactattatgagaaaaaagaattaatacattaaatcacagcaatctatattggcaaggttactttcataactattgagaaattatttgcagagcagtccccaactagtgggttgcctgctggtgggagagggataaagcagttagtgcaaagatcctcaaaatcatacaaacctttgtagctcttcaactgactaacagtgcaactactatcatccccgaaagatttttactttaaataaaagttctccaaaacaccaggagccactgtctagagcaatggcctcaaatggtcatgcattttatattaggggattcagtctgagtaaatgtttcctatctatgccaggccaaaaagtaaactagatagcttttcttctctaaaaataatttgcaaattcataaaatatttctttagcatggttttgctaaagttacttatttaagtaagggctttttaccttgacaaaaactggtagaacataaaagaatttttgctgagaatgaatactaggaaaacaacactgccaaaatgttctaaaccttgtaaattctgaaccattttattaactaattatccctctttagccaggagctcgtaacagtaaagaatctgaagtttgttctttgttgagcaagtaggacgataattacttcttcactgttccttctttgcaattttatgtataaataactctaccttttagtgagtgcccgctaggctctgtgctatttttacataaatttgatttcagccttccaaccccaaaagattctgacttctccacacactcttctcaattttgggtgattttgcccatttcaagtctcaattatctgtataatgaaagaagagaaacaagactgcataggaccaaatagtaaaggcaaaagccatgtatactatgttctgtagcaggttttacttgtgattttacaattaattggaggatgctggcaacaggctaaataatgacaggtataaatcaaccttggattaaatttttgaataaataacagaaacacaaaaagcagtttttagcatgtagaattaggcacacagttcttcccaagtaaatgtggatgggtactaaatgttttcacttttctgggagtttactcctagatcaggtgggaggaaataatcaagcattgtcatctgacacactatctctgccaggacatggaaatctattttgttaattacattctgcctctgagtctaaaagaaataaacacttaaaaaaaagtggaccttttatctcccacaagcagcattgagcctgacccttttgccagtatgatgatgatcattttgggtgtgtgtaggggttgtgaggttgagaagggaggggattcaacattgaggaggaggctatgcttgtgtttcagcttcagactattggcagttgatacggtttggctgtgtccccacccaaatctcatcttgaatttttgctcccacaattcccacatgttgtgggagggacccagtgggagataattgaatcatggaggtggttcttctatactgttctcatggtagtgaataagtctcacaaaatctgatcgttttataaggggttccccctttcacttggctctcattccctctcttgcctgccgccatgtaagacgtgccttttgccttttgccgtccaccatgattgtgaggtgggaggcaacgtggaactgtgagtccacattgggcaactgtgttccccagccacgtggaactgtgagtccattaaacctttttctttataaattacccagtctctggtatgtctttatcagcagtgtgaaaatggactaaaaattgccctggtttccttttgtcactgtgtggtagaatgctgactcaccaacttacaggatacggcaattttccattgcagaatccattatgttgcaatagtaaacgctgaaagatttcatagatcatggaaagtataggcttataagaaatgattgtagtaatatctgagttataaagcaattttatttgtacacatagactttaagaaaagattcataatttctgatcaattttctgaatagtcagacacgaattttcttgttaataataagtcatttttgagcattagctttgtgctgggttctttacagatagtctatcactttgggcctaactattcaatagaaagtattcttattcctatttaacaaataaggaaactggtgcagagatatcaggtaagtcccccgaggtcacctggccataagggaaatactaggatagaaattcagtattaactaactccaaaacacgatctcttcctggtacatcaggtcaaccccttttatgtaagattattcttgcacctgttgtaattctgcaactttacttgatcatcttcttaaatttctgcttaaaagcctccagtggtgctttaccatcttcatttttaaagagacaaagtcctcacaaatagccttcaaagacctgtgctgtttgtctcccacccatgccacgtattctctcatcctacctcctatttctttcctcctcatggttctaccccagccacactgaataggacacatggcatgttcccaccttaggggttgggcactagttgttttctctgccagagagccctctccccagatatccatagctgtctccttcgtctgatacaagtctttgcttaagggtaagtttctcattgagatcttccctgaatgccctatttaagtttgcaaactgcccaccactcttcatcccacttccctgttttatttttccccatgatgcttattaccatctgacattctagacatttgcctacagtggtaccccctttactcatggaggatatgctccgagacccacaggggatgactgaaacagaggatactccctaaccctatatataatatttttttcctccaacactgctcctgtcctaactttggttatttcaatatccacatggattatctttcctataccttgacctccgagctccactcccccaataagcctgcccttcattgtacttccaggcttcactagacctgtcatgaccaatgactacaaagcctccataaccttaatcttaaacatcctgctctctttctatctctttccttagaatacattaatccttcaattttttggttctgccaggatctacagtctgttactaacatttcactgtctctcacctccctcatatcctcactctttccttatgcagcttaaatgccatgttctgtcattataaacactgacttgtatacgcagccaactaactaccttgcctctctgtctcatcagcctcttctggccaagcccaaccttggttaggtctaaccacccacctgctgcaggcctgggcttttgcagctgaacatagcaagtgatttcaccttaaatcattcaccccaagcaggctctacctgctgcacagcaatcacatcccacttccccattccctctcccagtctgttggatgaccatgtcctatggcctcccctctcttcagttctctagtcctctccctcattctcatgtccacttgatcaccttgatttccatttcactgagcataaaatcaatccaaagagaactcctcatgtcccactaccacatctacccatcttcctgtgtctatgcccacatcctttctcctctcttccgtattttaagtcactttttaaggctggccccttcaccggggccctagatcccatcgcctctcaaaaactcaaggacattgcttcagcaatcctctcccttcttccctaatcatctgtattcccctccctactaagttatttcccatcagtgtataaacatgctgtagtttcttccatcttaaaacaatgtttcgtgaatatggattaaaagacacctaaaagacatcagttgaatgccatgtctgggtctatttggatctgacttaaacaaggtaagaactaccttgcctttcttggaaaactgatgattgaatattacacggccttaaagagttattgttttagatgttatttatttttaaaagattccttaattcttagaaaatattgaaatatttataattttaaaatatcccttccttcaaatctacttccacctactgccctatttatctgtgtctttttgcagcaactatcccaatttctgttatgctcactccaatcaggttttcacttcccaccatgccactaaaactccgtttaccaggtcaacagtgacttccacaattgctaaatcaagtggccaattagtacttatttcagaggcatttgactcagttgctgactccatcctccttggaatgtattcttcttttggcttccaaatcactactctctcttggtttttctccatacctctgattgttccttcctactctgtttttctagctcttcttcttcttcttcctgatctcttaatgttggagtgccccaggcctccatctttgatattctttttatctatatcttcattcacttccttggtgatcttatccacttgtatggatttacctaatgcctatgatacccaaatagaaatctccagtccagacaattctcccaaattccacgcttataaaacactgcttgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctccaaaaaaaaaaaaaaaaaaaaacactgcttgactgccgtcaccatctggatgtctaataggcatctcaaacttgacatgcccaaaagtgaatttctgatcattccctccaaacctgcctcacctgcagccttccccatctcaggaaatggcaacttcattctcccagctgcagactagaaatcttggagtcattctcaacccttctctttctcacataccccatatcccatccatcagaaagtcccaatggctctacttttcaaatatctacaaactccaaccattttcagtatctccactgctaccaccctagtccaaagcaccatcctttctatttttgatctccctgtttccacgccttactcactttggtaactttcaaagcagcagccagcatgatcctttttaaataagtcagattataccattcctctgcagccttttgatctcacttccatgaaaatgtaatgttctttcgacagcctacaaggccacacatgatctggctcccaatacgtccgctgacttctcccacatgttctatgccctcaccgtctcagcaccagcaacactggcctccttgcttcctcaaatataccaggtgcactcctcacagtctttacactgctggtcctttggcctgcaatgcttttgctccagatatcagcttggctgtctccctcacctccttcagacacctcctcaactatctcctcaatgaggccttccctgacactgtcccctcatctctcattgtgacccactcctggtctctgccttttctcttccctgttccccttttccccatagtacttatcattatcatctaacatactgtatgtcttcacttttttaagaaaaaattacctttttctccactagaatgtaagcatgaggagagcaggaatttctgcctgtttagtttactattatagccctagcttctagaactatacttgagacatagacagcaatcaatacattctgtacttgctaaataaatgcatattgcatttctaaattatttaaacatattaatagacaagctcactgtcttgaatttataccttttaaacctttaacttatttttcaattcaatattaataaattaattacattgtattttaaacagtaaattaatctttctgctcttagatgcatttcatttaccaatttacagatgtaactgcgcatttataatggagcagcttccacatattgacctttgggaaaacctactttcatgacaagcaaacagaaaagacacttgcaattgctgttggaacactggcaagccaattagtgcttctttaatttgcaattgaatttatcataaattaatcttaaataataatcaatgacaaaatatctctcaaaaaataaaaatagttccaatgtttggggatactagagggcataattgcttttgaggttcaatttgctcttcctatgacattaaacgtagttagctcttttttttcctggcatcattaaaatctcatgatattcttctctgtatataatactgcaggactcactctctccaaattcaggtcctgttactttcattagacacttaactcgagattattcccacgacctaggcaattagacttcaaaccatctgccagactcagctcagctgcattctgatttgcgagtaaatacttgctagagacaaattctcatggagttcaatgcccattgcttgatgagctctttgaagagagtgccagagtcaacaaaacagagggaagccctccagcttgtagctttctatccatatggctacatccacaagtgatttcagaccccttcatcacccataacaactctttatattcttcttactcagaaaaaaaaaaaaatactacatgttgacaggtttattttaggaaagaaggtacacactatttaaaaatcctggatttgaagtaaccaaataaaactttgggtgagtgggaaaaaatacagcctcaaataacttaaaatgattcctgacttgttgagtttgaggatctcttcagactgagatttattctccgacaactccagaattgggagactatcaaatgtggctcagtactcaacaagtatttgttccaagctcttgcacagttctgtgtgctaaatacagtagtgattaaaagttaaagatgaagcattacacctaagattttattttctctccctcctgagatccccttaaaaagatgagaaaggagtttttcctatttatacatccacaagaatttttactatgcatacattcacagaagacaggtgagagcccatccatggtctgaagagctacagaattcagaatgaagaaaaatagaaaagaaggaaggcaaaactcacagtactcagagggagcgtagtcagagactgctgccttgctctgtaaaatctctgggaggaataggacttagaggtgatgggtatggcatgtggtaagagtaagacatgggactgaaaacagaagggttaactgaaagtttatatctggaagcattaatcctgtactctatttatgcaaaattccaacagccaagtacctccccactaagctgaagaggttgagaaatcctaaaacaaaaaagacattcacattctggcactttagggtctaccaacataatggccagctccctaaacaattaccctaaagcaaagtctgccaacagaaaagcaccctcttaaatacgaatgtgtgcaaccagagatctccagtcaaagaatgctcctaacatggaagatcaaaaccaagatacacaaatggcggggaaatgagcctggagaaatcaaagaaatcacagaaaagagaaaggaacctttaacaaagcaataattaaggacctgagataaatctgagaacacatttcatccctatcactataacaatcatgataataataataaaaataatagctaatatttattgagaacacactaagagctactgttcaacaaactcaagacaaggaaactgcagcacacaaagtttcagtgactgatagtaagcacagaagccagggtttaagtccagatagtgtgaatttaaaacccatgttcctaaacaaaggggtatgctttctcaaatatgctggttttatttcattttattttttattcttttttattttttatttttagaaggagtttcgctcttgttgcccaggctggagtgcaatggtgcaatctcggctcaccacgacctccacttcccgggttcaagcgattttctcctgcctcagcctcccgagtagctaggattacaggcatgtgccaccatgcccggctaattttgaatttttagtagatactggtttctccatgttggtcaggctggtctcaaactcccaacctcaggtgatccacccgcctcagcctcccaaagtgctgcgattacagatgtgagccaccgcacccaaccaaatacgctgtttttaaaaggaacagaacacaagaaagtgctcttaaaaaatctattcaggtatttaacaagtatgtgtttagagtcttctgttggctaaacaccagtctaggtaccaaaaatacggcaataaacagaacaggcagtatttcagctctcatgaagctaaaattaaaaatttagtagaagagatggaagatgcactcaaggaattttaccaggcaatttaataaaagtaataggagaaaattccaagaaaaaatggagatatgtctgatggaccaggaggtgccttttcctcttattaagaattccagagacaaaacagataaaatgagaataagttatcccataaacaatacaagaaaatttcctagcagtgaagaacaaaggtcttcagattgaaggggcctgtcttcccccagtgcccattataataaatggaaaaagattcctatcaaggtacaccttcatgaaatgtcacaccagggataaagagaaggtctgagaagcttccagaagtaataacaagtcaatgaccaaagaataagaatttgaatggggtcatacttaccaaaagcatcaatgggtgctagaatatgataaagcctttaaaattctgaagaaaggcgatttgcaaccttaaattttatagccagctaaagtaccaattgaatataagggtagaaaaaaataaggtcattttcagacatgcaaagactcagaaaatatctccttcacacagcctaagaaattacttgaaaatgtgctctaggagagaaaatcaagaaaaaagatgacacaagattcagaaagagactcccactggggagaggggaaatagtctcctaagaagcttgaacttcattctgtagatattaaaggaggcatggatttcaagctggaaagcaatataagatctgtgttttagaaaggacattctttcctaagtctttcctaatgtcctttagaaaaaacattctttcctaagttcctaaaatcagaatagtggaagatttctgagaccagtcacaaagtttttgcaaaactcaggtgaaatgtagttcagacctaaactaaggtggtagcaatgagaaccatgaaattgtagatgtgcaacagctgggctcacatctgattggggtggggggttcttagcacaatttcatgttgttgtaaatattcacggcatgaacgtagggcaagggcaagagagactccacaaggacatcgaagcttcaagccctggaaagtggtagatggaagacaagaaataaagacattccagtaagcttcaaggcaagaatcattctatttgagatattttgagtggagaggcagtgctagatccatagagaagtacagaggagctcctacctttctgtctgatagcaaccagactgtctgattaaaactgcagatcactgcaagggtggttaaatcaaaaaagaaaaaaggcagttgttccccctgcttgaccctgaaagtgcagagatagtgtgggtggactgcacaggaacacttaaggtgcagcatgcctaatggatacttagaacgatgacaagtgaggattaagatgtcttcaagtataatagattctaattttgtctgtaagtggccttagagctctgagatgagactacagaggtagtccagtgctagatctgcaagaccttaaagggcatggtaggaagcgtggatgttattcatggtacgttgagaagtcactgtaggcctttaggcaggaaagtgacattactcaattcatatgttatgattactctggctactatgtgaggaatggattgaaaaagaataaaagtggacaggaaagatatttcagtaagagataatgttagcttggactagaaagcttacactggagatgcaaatacgtggatttgagattcctttggagttcagaatcataggtgttttgcaagattaaatgtggatgggacaatggtcttgaggaaatccaacattcctcaaggttactaatttgagcaatcaagtggatgagagtgtcaattaccatgttggggggaaatagaggaggagcaggttgagctaagggcaaaggatgaaaagataagttttgaaaggccctattaagttggagacgcctgtgaggcatccaggtggagatatcaaataagcagttggatatacaagttgaggtctggactggagctgtatttgccaacttcattgcttttggcttcagctcagataaacttcaaattgggacaaggaggaaattaacaattattgagcacctaccatatgccaagcacccacatttcccaacatctactttctccttgcctgcccaagcaccctcccagttcagcccgagtgggacctaacttagaggccacctgggatatgtcattacatatactcagacaaactttggaatcttccctcccagattcctaatgagtccatggagacttactgcacctggatctgtgttcaaagactccaaagacctgaaagtgaagactagctcctgggacactgaagctgagaactccagacccaaatgatacttatgactccacccttggttcactgtatctttttggacacaacatcccttatttctttgtctgaattttagtatctgcccgcttcataaaaatgctttgagaattgaaaccagcttctgaatcacctggagagcatcttaaataatgcagattcccagcctccacaaacagagattataattcatttggtctggaatgtgtctcaatctgtattacaggtgattctgatgctggtccagagtgatccctggactagaaatgctgatttgcagagtgataaactgccagtttttccccaaattatctgcctcaatgctgtctccatcacttagaacattagggcagttttaaaagaaggcaccgaattctttgacactcttcccattaagaggtggactgtatgtcctctgcccttgaatttgatagttctcttagaatctggctgacataatgtgggaaggtcaagccacatggagtagccacagcaacagtcccagctgagctcagtctttgagtcacctcagccctggcaccagacatgccagtgaaggaaattgcagataatcccaacccccaggcattgagtcatcccagactccagatcttcccagctgacgccccagacatcacagaacagagacaacctatccccaccattccctgttcaaattaatgatccataaaacctatgctcataataaaaagattgttgctttatgccacttagttttggggtgttttgtcacgcagtaactgaaataattactaacatgttttctcaagaaatatgtattaaaatgcaaacacattacttggatgaactctttcagatgaacacacacaatcagtgtatctagcagacaacaaagcagggaaatgagccatgagatgctctcccgtttcactgacgtgaaagcatcactgggaaaggcaacctaagatgcttccagaaagctggaattgaaagatggccacaccttgaagacagcatggctaaaagagaaagacatgcctcaaaaaggacggatgaggccagagagcaaacccagattcattttcttcacaactgtgcttaagtctggctcaaaagtccctccactctctcactaaccgcaaaggtgtttatttatgccagtttataaatgtctaatgttaaaaatcacctgggaataatacaggaacaagcgccaagggtaatttttttttttttttttttttgagacagagtctcactttgtcacccaggctggagtacaatggcgtggtctcagctcactgcaacttccgcctcccaggttgaagtgattctcccgcctcagcctcctgagtagctgggactacaggcacgtgccaccatacccggctaatttttgtgtttttagtagagatggggtttcactatgttggccatgctggtcttgaactcctgacctcgtgatccgcccgcctcagcctaccaaagtgctgggattacaggcgtgagctaccgcacccagcagcaccaagggtaattcttaccagcagaccagtttggaaaatgctagattatatatttttttaattaaatacaaaacaaaatagcaactgcaccaaccctttcctcacaagagtaacagtcctgtggtgagaatggggttaatacatgagctttaagttctgacggccttgaaccttgagaatgtaaaccccagctaagtccaattacaacgatgtggggggaggaaatggaaaataatggaattcactagctaattggatactattaattatattaaatattttaaatggaattatcttctatgaggaatattttaattgacaaaatataaaataggagggatattaggttaaatattcatggccttattcaagctattaatggtgccaataaaaatgatggagcaagacatggaacctggactctctgggattcagaaaagagcagagaatgccacactaatgccacgaattcattctattttagtaactaacactgatgtctacatgttcccagcctgaccaccacccccctcaccccattgttctcagaagtgatttgaatctgatttcacattgttaatatcaacacttgagttttctttccaagaatcaatttacagtcttctaaagacactggagtggcgggggatggggggaaatgttgtcagtcatgaattcccaatgtaactggttatgactctgaggtctgcatcattatcagattttcatgatactgatgttgattcatatcagtgagcagtttatcagtccccaaactctagtccccacagcagctgatagcaaagtagtccccttcgtctctgttctacttcatttctcttgcctcttgagaccctttcatagtcacatggtggcatgttgcagagtaaaattgacatctctctctgattccaagagtttgcatgtattgtgatggatagaataaaatgactgtggaaatagcatttgtactactggatactggaattccaaggagttcctataacacaggcttagaagcctaatatccatccctccttagaccagaagctcagcttatgtactcagtagaagaaaggagcatatcatctcccaattaacctcaggcctgtttgagtttctggccaaggctgagaaggccctggctgctcactgcctctctgcatttttctgttctctgcctcccagggacgtgtctcaaaccagtgtcactgcccttccatccaaaggcctggagcacctgaaggaactgatagcaagaaacacctggactcttaagaaacttccactttccttgagtttccttcacctcacacgggctgacctttcttacccaagccactgctgtgcttttaagaatcagaagaaaatcagagggtaagtggcagggacccggcataagtgacaaaagaccttggtggaagtggaattcatttcttggttttggggaagatgcttcctggtttgaaaaccaggtggagaggaaattggaagcatccatatgaaacaggaaatccatgggacacagtgaccctgcggacccaaagtgggtgcagctgagaaataaggcaattgctgctggatagcggtagagcagaggaggtgacagatggcacaggagagagaaacacaaccagatctcatagaatcttgtagaggttatgtagatatgatgtccggtttccaggtacaattcagaattagatactgcaacacatattagaccccagacaccacaaccatgagaacagacttataaacaacacaaacagttgggttacctgattggtttgggccttgcaaatgtcatagctccctggttacatgcctgcaggctttggagtcagctgggtttataccgcagctctgccatttttcaagctgtgttatcccagcctagttacttaaccactctgagtctttgggaatggagatcctaatactaacattcatagcagttttgagaagattaaatgagaaactgaatggaaaacactggaatggaatggcctggaatattataagatcttcattaatattaactatgatatacagtatgtgcacatcaggctgcttatgagcctgcgaaggaggaattgccttcattttctctccaggctttctctgattcttttacttttttgcttttactctgcattatttcccccattgtgtcttgtacaatctcctgttctcctaatccaccttcatcatctctattcagtcctcctcagcttctatgtatttagtgattgacttactacacacataattgcagtcaggaaaatatcagatctaggtgtgagggcagaagctaaaacagccatacaaagaaggccaatatggtggccgggcacagtggctcacgcctgtaatcccagcactttgggaggctgagatggccagatcatctgaggtcaggagttcgagaccggccaggccaacatggtgaaaccccgtctgtactaaaaatacaaaaaacaaaattagccagatgtggtggtgggttcctgtaatcccagctactggagaggctgaggcagaagaattgcttgaacccggtaggcggaggttgcagtgagccgagatcgtgccagtgcactccagcctgggcaacaaagcaagattctgagattccatcacacacaggcacatgcacacacacacacaaagaaggccaatatgggcatcatagctgcaaaaagccaggagtggggtagaggatggtgatagtggactctacactgatgccatgcggcattgagaaggactggacaagggctgggtgggaggcttaagtggacctcaggggcagggtctagatttttccctagcctccagttgagaagagcaagtccattggacattttaagcagaacccaagagatcactcaaactctgctcagcagctgaggcaagttaaagaatcccttttgttgtgagtctggtgagcaaggaaaaaactaaatcttatttccacaagcatgcctgtatggtagtgtccatttgttcatttgttaaacagatatttactgagcaccttctatgtgcctggctgttgtaaatagaacagacaagaattccctcttgtattttgcttactgtctaatggaggaagtcagaaaataaacaggctggccgggggcagtggctcacttctgtaatcctagcactttgggaggcagaggtgggcggatcacttgaggtcaagagttcaagcccagcctggccaacatggtgaaaccctgtatctactaaaaatacataaatgttttatttttaaaatattcagtttgaaactaaataatgatgagtagaggcagccatgggtttttcaggcaatgggaacatagggttttagagctttgaataggaataataataacaataaccaccatatggcactcacaaagctgcaggtgctattgtaagagccttaaaaagataaattcattgaatcctttaataaccctatatgaaatagtcactcccattgtcccatgttacaaatgagttaaccaaacttcatgggcctacccaagctagtcaataattgagccaggttcccaccaaggcgactggctccagcatccacattttttttttaaacagagtctcactctgtcgccactcagcctggaatgcagtggcgcaatcttgactcactgcaacctccacctcccaggtttaagcgattctcctgcctcagcctcccaagtagctggaattacaggcacgtgccactacgcctggctaatttttggattttcagtagagatggggtttcaccatgttggccaggctggttcaagctcctgacctcaagtgatgtgcctgccttggcctcccaaagtgctgggattgagtcactacaggtgtgagccagcacacttggccacttttttttttttaatcactgttcttgaagtggttgcagaagagaaataagaccaatgccactggagcacagtaggggaggggaggtcataggaatgatgtcacagaaacaggcctgcctggatcctgtagaaccttatagaattatgtacatcatagtaagtagtttgcacattttcataaatgtgggaaccattcgtgggttttaaacaagcattcttttttttttttttttttttgagacagggtctcactctgtcatccaggctagagtatagtggcctgatctcgcctcactgcagctttgacctccccaggctcaggtgattttcccacctcagcctcccgagtagctacgaccataggcacataccaccatgcccagccaatgtttgcattttttatagagatgggatttcaccatgttgcccaggctggtctcaaactcctaggctcaagcaatccacctgccttggcctcccaaagtgctgggattacagtcatgagccactgcgcccagcctggcactgactcttttctgttgccttgcagaatccttgagtccttgatgtgtaatgagagcagtatgcagagcttgcgccagagaaaatctgtgaatgccttgaatagccccctccaccaggaatatgaagagaatctgggtgacagcattgttgggtacaaggaaaagtccaagttccaggatactcataacaacgctcattattacgtcttctttgaagaacaagaggatgagatcattggttttggccaggagctcaaaaacccccaggaagagactctacaagcttttgacagccattatgactacaccatatgtggggacagtgaagacatggtgtgtacccccaagtccgatgagttcaacccgtgtgaagacataatgggctacaagttcctgagaattgtggtgtggttcgttagtctgctggctctcctgggcaatgtctttgtcctgcttattctcctcaccagccactacaaactgaacgtcccccgctttctcatgtgcaacctggcctttgcggatttctgcatggggatgtacctgctcctcatcgcctctgtagacctctacactcactctgagtactacaaccatgccatcgactggcagacaggccctgggtgcaacacggctggtttcttcactgtctttgcaagcgagttatcggtgtatacgctgacggtcatcaccctggagcgctggtatgccatcaccttcgccatgcgcctggaccggaagatccgcctcaggcacgcatgtgccatcatggttgggggctgggtttgctgcttccttctcgccctgcttcctttggtgggaataagtagctatgccaaagtcagtatctgcctgcccatggacaccgagacccctcttgctctggcatatattgtttttgttctgacgctcaacatagttgccttcgtcatcgtctgctgctgttatgtgaagatctacatcacagtccgaaatccgcagtacaacccaggggacaaagataccaaaattgccaagaggatggctgtgttgatcttcaccgacttcatatgcatggccccaatctcattctatgctctgtcagcaattctgaacaagcctctcatcactgttagcaactccaaaatcttgctggtactcttctatccacttaactcctgtgccaatccattcctctatgctattttcaccaaggccttccagagggatgtgttcatcctactcagcaagtttggcatctgtaaacgccaggctcaggcataccgggggcagagggttcctccaaagaacagcactgatattcaggttcaaaaggttacccacgagatgaggcagggtctccacaacatggaagatgtctatgaactgattgaaaactcccatctaaccccaaagaagcaaggccaaatctcagaagagtatatgcaaacggttttgtaagttaacactacactactcacaatggtaggggaacttacaaaataatagtttcttgaatatgcattccaatcccatgacacccccaacacatagctgccctcactcttgtgcaggcgatgtttcaatgtttcatggggcaagagtttatctctggagagtgattagtattaacctaatcattgcccccaagaaggaagttaggctaccagcatatttgaatgccaggtgaaatcaaaataatctacactatctagaagactttcttgatgccaagtccagagatgtcattgtgtaggatgttcagtaaatattaactgagctatgtcaatatagagcttctcagttttgtataacatttcatactaaagattcagcaaatggaaaatgctattaatttggttggtgaccacaagataaaatcagtcccacgttggctcagttcaactagatgttccctgatacaaagagaacttgatttccttaaaactgaaaagccaaacacagctagctgtcatacaagaaacagctattatgagacatgaaggagggtaagaattagctttaagttttgttttgctttgttttgttttttaactcaacctattaatcatctcttcacaagaatccacctgatgtgaccaagctattatgtgttgcctggaaaaactggcaagatttcagcttatgtggcctagcaaactaagaattgctcttcttggccagcctcatagcataaaagatgtgaactctaggaagtctttctgagtagcaataagtgggaattatgggcagagcacactcaatcccctgttgattaataaaacaggctggacactaattaactatgggacttaaatctgtagaaatgaaggagtccaatagcttcttccaattttaaaactctagtacatccctttccctcaaatatatatttctaagataaagagaaagaagagcactaagtaagtagaatctgtttttcctattttgtagggctgctgactcctagtccttgaagcctagacacatgacccaggaaatttttcctttgtttcacttttgattatgatgtctgagccaaaaattcaattaagtaaacatactcgcctggatctgaatcattcatttaattactagatctacccagctgttatatcaggccaaaaacagattcgtgtttatataaaagagtaaacgatggttgcaaattttggctatttagagttgctacttcactatgaagagtcacttcaaaacacttcgcttgtctttagggatgatttttgccatttccagtccacggtatgatactaaagctgtcaagagaggtttcttcttttctgaaactgccagctctttccagccctgttgatcactggacataaagcttcttttccccaataattcttctttacttaaaatagtcaggatctttatctacagatgtactctccaggttacctgtgatgatagccccctaatgtcctgctagaaaagtctccaagcagagatgacattacttctgaatgctcataaaccacaccatgaaataaaagctctttgttgttttaagattgtgaagtgtcgttaatgggtccccacagatggtccctgctggactcacctggaatctctccacagccatacccactcatcactatcattgagacctgcacatcttaatagaaatattataaacatcgaaaatcatgacttacctagaagttcgcttgtaactaatgaaattaaacaaatgtgttgccttttgtcatgtgtttctctcctgtgacatttcaaaatatcacatcttgataaataatgtgtttcatcttgaatagctgaactaattgctttggaaacagagtcctagaaaagtgacttcaacagaattgttactaaaatttgcactcacaacatgaaataaattttcttcctatggaataatcgtg

SEQ ID NO: 107 - DNA, 74283 bp, Homo sapiens
cgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacggtgagtgccggaggtgggcgctgtcgaccccaatggctctggctgagcctcatagccctttgctgatggctgagggcttggccagccaccggcccgcctgggacgccgcgccctccgccatagccaagggtagggaggggaccggagtgggatcctggtctggtgcgccctcaggggttgagggggtgtccaggctggaagtttggacggggcgaggcctgcctctttctcaggttccagttccctgtgtctgagatgcaacagtcaggacggcttcgttggggcctggggtttccccttttccctgatgggccatgggcacagaggagaggattctggtccagaagacaacactttccccaacccaggaattggcacctttctggggcaaggctgccaatgtccaagaggggacatgggaacagagaagcagggagaaaggagggagccgctcggggcggatccggcacccccactcatctttcccacagcctcaccgggtggctccagctgttttccactaggaggtgaggagagagatgtgaggaaatcgtcatcgaggctgcacccgagagcaccaacacttatttaggcaccagtctgaggagaggcctaccccatctcctgggagagaggaccggtttctccctcctctccacctccaaatccctgcccctcctattgcttaatgcctctctatctcctcctatcccctccggactattttgtgtggtgtgggttttctcgtggggccacacctttctagagtggtggttgatttggggatgcgtctccaccccactggctgttacgagaggaacagaagcctcctgggagtggggataggggggccggatgcccaggagggagaggggaggaggggtgtgcctgactaatgagctctgcttgcttttgtgcaagtcatgccaaatggctgctgaggcccttcccttgctcagaaaggcctggtgaccaccctggcttgagtcccttaggccaaacagcttgttgagctggcctaggcaatgcagtgctcccaaacatgtctccccaggactgcttgagccttgtagaggtgagatagtgactagtagccttgaaaagggctgaaggtcccctgggatgagaggaggagagttgggggcccagccttttgggtttgtgatgagctttggttgccacgttactgtataccagcctcactgccaagtcgttcttgcctttccagaaccttgtccttcagaaacaccaagttttcaaaaagtatgtgctttcactgtctatctcctttaaattgcttgtggttttaggacatgaggcttttacacactttgttccctagtccccgcccccaaagagagagagtaatggttttggagagaggggaaaatatcccattgtctgccaaaacaagattataaagatcctgtcaggagcggctctttgggtctctctctgtggttgactcctgactcctcttaaggtgcggctttgcctgaacagttgggtggatctctgggaatagacattgctccacggtctttcttctgtagtggcatatctcatcctcagttctgagatagcccactttgaaacacagcttcatgggcctggaagttgcttcaaacttgcattaaccgtctcatctgagtcaaagtggcaaagaagacaagacagcgtgtttattgttttcctgggaatggagagagaatggagtataagctgtttgtagtcaggcctggagtaatgagggtacctaaatactgaaggcatttttatgcagattgactgaaacctgaatcaaattggaaggagagggctgaattttgatagactggaagtattagagaattttctatactttgactcaaggaatggtcaacttttaggaaaagcaactatattatgtctgttaagatcatagaatcttaacctgaaagggaccttggagactatttagtacaactctcttaaaaaaaaaaactaaaactaaaacaaaaatctaatgaggctattgagacctacagggaaagacctacctaagggcacatggtgactgagccaagattggggtccaggctttctgatgctcatctcattgaccctttattctgacccaatgattgagttcttgacatttgagttccctttcttgctccaaacaaattgcccactgttctcagacctttatggtcctcagataaaaggaaatgagtaatttgagcaaagtggccaaggttgacatttgtgtggtctcctggtaaggttcggtagtgtcaccaggtgccttctgttacttttcttattcctcataccaaggccaaggtgttcaggggcacaccctagttcactgaataccaaccagtaattttaattaaaaggggaaaaaatttccctttctctgctccattttcatttatgtgctttaggctatttctagcgtgtgacagatggagaaaggtagtggaaaatcaaactcgttcattcatattgcagcatgtctacaacctatctagggtcggtttcacttttatagctaattgtccctcctagtcagcccaacctcccctacatttgttaaaacacgccagccgggcgtggtggctccagccagtaatcccagcactttgggaggccgaggcaggcagatcatgaagtcaggagttcgagaccagcctgaccaacatggtgaaaccctgtctctactaaaattacaaaaattagctgggcgtggtggtgtgcgcctgtaatcccagctactcgggaagctgaggcaggagaatcgcttgaacctgggaggcggaggttgcagtgagccgagatcacgccactgcactccagcctgggtgacagagtgagactccatctcaaaaacaaaaaaagcaaaaaaacaaaaaaacatgcctcactacccaccgccacccttgccttcttgccattccttggactctgcttctggttgccagtttcctgagtctgctttagtagccagaatggaaaagcttattaattgccatctacattttttggtgatgatgacagttatatatatatatatatatatatatatatatatatatatatatatatatatatttaaaaaggcctttccccctccctaccttctttaatttttttcttttaggatcacaaaggctttgaggctttcttggatttcctaaaaaaagagtgttttgaattttcgagatgttcttgagtttctggtttccttccttgggatttattagatgttagtattgaaaaggctctccacaactataaagtccaattcctctcattgtatagatgatgaaactgaaactcatgttagggggagactaacctagagtgatgcagtatgccagttgcaaaactaggacttgaatctaggtcttagttagagggtcagtcttggtgaaacacctctttgatctgctggggttttagccatagatcaacagatcaggggaaaggcaatcgagtggtcatttgatgggaccatcaatgtgagcagacatagagcctagatccttgaagtatttgaaggtgtttgggtcggcattcagctaaactttaacagggactatgtggactgtttattctcctgccattcctagcattacttgagccactcgagtggcactaaagtggtacttggtaaataggagccagattcttagtcttttaacccttgaaccagccctgcctacagacttaagtggggggaaaaggatcaggaagagaggtcatatgagagaggatcctgcatctctccacttgggttcttcagttcacttggccctttgtgaaagtgtagatgatagagacagagcaggaaccatcttgggaatttcctttacgcttttcttttaacagccctctgggtagggagggggctggtggggcaggaaggcctttgtgggacccacaccaactaatctatgctctctcgtgttaggcttggagagggaaaggttgctctgtgagtcagtgatagaagtagtattgatcactaatcttctaactttccattctctagctgcctgcaacagtagcttgttttagggtgttgttcttacttttctcttacctcctcctcccatgaaactactttaccgaatgatggagctggaaaggacatttggaagtcatctagtctatttcccctgcctccaaatctaattctctctggatgagataatatgacagctacaattattctgaactctgttctagtgttgcatggcaacagcctgtcttaggtccctttgtatctttctgggagtttcccccactggaatttctagactcagggtccccagaggggagaatatctggctaccaacactaccagagttaggcctttcataaccatagctgctggaaatttggcattgttacagattgctaatagtctgtctctaatctttcaaagatagaattgaatttatcatgtgcctctttcctaactcagaatcttctttccctgccacctgctctattactttgcttgcaaaaaggaaaaaacagggtacagatgtggtctcctttgggatagtctgttggttcaagtgaagggggtggtcttttcatgactgactggctttgctgtccatccctccttccatttcatgcttgagagagctgaaaaacttttcaattccaggttctaatctgtggtatagaagttgtcactttggaggattagctcaggattccatgaatttggaaggtgggtgctgggaaatggaaagcatcactgaactgagaatttttcttctctttccatataagaagaacttctctcctgtcctcagtaaagtgagccaaatgaagtgggactttaggcaagtcctttcttcaggccctctgtctctccagcttgtcatgagggagctgtaccagtgatgggtaaactctaggaatccctccagtactgatgtttttgagaatcttgatggtataagagcattgagtctcttatatgtatgttcattccttcagacattctttcttcaacatttgggtaccttctatgtgccaggcagtattggaaatacaaaattgaacagcgcttattaaaatgtatcctcttgtcccattatacttcttgagtgctgtttcttcttaagtgctgagttcagaatggactgtttctcacatgggagttggtttgtttcattagtagatccaagaagaatactggcttgagtactcttggccatttcttcccgagtcatgggagagaaagggctgtgtctttccttactgtggaaagaaataaaccaagtgagagtatattatgaagactgtgggttgactgaaaagctttggacaaacactaaaagcctcatagattttcctgccattcttcccacatttttcagtgaccgcctgcctgatagtagaatagtcctttttatttctgctgaaaggaaggcccggaagctactagattatgtttcagattttcttctaacatggtgagtgtggtagttagatatattggtagatattgaggccttcctaagggctcctaaacaaacctcataaagtatctaccaccagtgagctgaggactggctattgtggggtacagctttttttttttttttgatacggagttttgctgttgttcaggctggagtgcaatggcacgatctcagctcactgcaacctccacctcccgggttcaagcgattctcctgcctcaggctcccgagtagctgggattacaggcatgcgccaccatgcccagctaattttgtatggggtacagcattttaaaggcatttgcatctagggcaacccagagcttccctagccttaagctttcctttagctggttgttctggatgggcagggtttctcacaggagtgttttgaaccatggaacaactgagctggccttaaatcttctgcctcagcctttatcttcttgatgggggcactaaagtccagaaaagggaaaggatttgagtgaactggtgatagtgccaggactaaaacctaacttgcttggctccagtgtaggggagggatggtgaatgcctaccttctaaatggcactcactgtgaggtgctcagtgtcttctccctctgtgctggtggtgacatgaccgtggagttatggccatgggaagagcaagttcctctgagtgtgtagagctgatctcatgggtttctttatttggaaatggctcaggctctgaccttgtctcaggaactctttgtagcacttcccaggaaggtaagtgttttgctttggcttgtgacgggtggtggaaggcatatgtgtaggctgaagggaggtagagagaggacactagtcacattttcctgcttgagactaggccttgctgtcctaagaaactttagagagtaatttcttcatcgtattcatagccagaggggttaggcagcttgttcgaggtcacatatagttggtaacagtattgaaaggagaacttggatttcctaattcccaagttagtggtctcccactggacttggctgtcttagaaggatgactccacccagagagcacagacttccagagaactggctctgtggtgattacattaacaagatgggtacaatggagttcccctaaaatggttttgctatagcaagtttttctgggatctccgatgactgtcttctcttcctgtctacccctcaccccagttccctgctttctctttgccctgtttaattttgagctctgacctttttgaattctgaattctgactcagcgctccagcttgatctgtcccttgagttaggagaacagtatggcactttttcaatttagtgacagtatttgctgctgtagcaaattgtttgaatgcagactagaatctcctggcctcaaagttcaccactcacctctaggtgcttataggccaagcctggggcaggaagctaaaaaaagacctttcaagcctccgtggaaaggaagcatagagtagtgttgaaaaacagactctggaactagactgcctggactcaaatctagctctgcgaccaactagttatatagccttggacaagttatttaacttctgcacctcattttccttaaccataaataataatagtacttacagagttgctgtgaggattacatgaggtaatttatgtaaagggcttagaactgtgcctagaatctaacaagtgatatacaaatgttatgattatttactgaattttactatatgcctaactttgtgctagatgggatggataagaaagaagacaggtagttgaattcttaccatttaatgagtggttactatgtactatttaccataagggatagaaataaatgaagggatgatacaactgctgccttcaaagatctcctatctcctatttaattggggatttagggctaattcacttaaaaacggcttgagaaaaatatatactttgcattgcattttctacaactttttgaggagaaagggtttactgggacatgaacagggccttaaagggtgtgtacacttgggagcagtggccgttctgggtgggaaagtgatgtgtttttggtatgtgggtgtaaaccaatggccctagaccaatgctctcttgaaagttactttatctgaagtgaagggaggcttgagctgctgactgattcaaggggagccacagatataagcatagatgaagctactctttctagggtaatttggatccaacaatcctttcttaattggcaaacaagggcctgtgggggagaccatacctttggttttccagaattgggcaaattaatttttttttttttgagatggagtctagctctgttgcccaggctggagtgcaatggtgcaatcttggctcactgcaacctccgcctcctgggttcaagcgattctcgttcctcagcctcccaaatagctgggattacaggcatgcgccaccacgcccagccaatttttgtatttttagtagagatggggtttcaccatgttggccaggctggtcttgaacttctgacctcaggtgatccacccgcctcagcctcccaaagtggtgggattacaggtgtgagccaccacgcccagcctgggcaaattaatttttaaaaatgttgcttttgttgcctaagtaggtatgtgagagggtcttttcttcatgcttacacatgaactaaaccaaagaatagagcttggcaataactttatgtcagcagcctagaaacagcttttaattctctcattgactttgctataaaatcaggtatttgggaaagggtggagatggcagggaggatttctcagtgtgtggttgttagaggtggaggagtatgacgttttctggccagggcacagctgcagcatctgggtcttgaatttggagaaaaggccttttgggcgactttcaaagcacagccctttgtctgtgcctaatgacacagataccagatctgatgctcctttcaatcggcttgttgtggcataaggtaagtgttgacatagctcttaggccactaatatggcaaatggctctgtgcttgcttagtagaactgttttgccagttatcttctgtgattggtgacttcgaatattgaagtttcttcccattcctggcaacccttctaccttgtgggaatttgatagatactttgtgcatccagggtagtgatcagggcctaatgagagaagagttgagatatgacaatttggttgtacaaaacaagatataatcctgaaaatttttttcctgggtatatatttgggaagtgactggggccaaggcctaggagggggaacaaggcatacctgtcaggcttgatcagtatttctttccctctctttagccttggcctccattaaatacctgagaaggatcaagtcttatttttctcaagttgtgtgtttagataaggttcctgatcttactttcgtgatctaatctgccttccctccaacccatgatccatttccttttttttcttttcttttttttttgagacggagtcttgctctgttgcccaggctggagtgcagtggcatgactttggctcactgcaacctccatctcctgggttcaagagattctcctgcctcagccacccaagtagctgggactacaggtgtgcgccgccacgcccggctaatttttatattttttttagtagagatgaggtttcaccatgttggccaggctggtcttgaactcctgacctcgggtgatctgcctgcttcagcctcccaaagtgctgggattacaagcgtgaggcactgcgcctggctgatccatttattttttcagattctcagcctggatgtttgatgaagctcaccaagagcctcttttatctgttgtaatttttaactgaggttgactaatctatggtatagagttggagggtgagggtcaaggtaacagtcaatctgggcatcattagttaagtcgtacaaatctttgctattttcaagggttttaagtgagctaaactcctctccaaacatccttgtagatacttgtgggagactgactaattcctttacaaagaagaaaagtcacataacttctttgccttttaattttctttttctccaacatgaaaatatcagcaatattagaaagaggcacatggagtttgcgtgtggtggctcatgcctgtaatcccagcactttgagaggctgaggcaggtggatcatttgaggtcaggaatttgagaccagcctggccaatatggtgaaaccttgtctctactaaaaatagaaaaaatagccgggcgtgttggcgggagcctgtaatcccagctacttgggaggctgaggcaggagaatcacttgaacctgggaggtggaggttacagtgagctgagatcacgccattgcactccagcctgggtgacaaagcaagactctgtctaaaaaaaaagaaaaaaaaaaagaaatatgtaaatggaaaagaacaaacccccctcccaggttccttattccccttggtgcctgggccattgtagatctagcatatgcttggtggggacatctgccatttgctttagggttacactacatctttctactttgagtgcttgaagagttgctccagcagggcctgatgtgggcctggtgaaaatctagcctagttgcctttctgtctgccatagcctgggcattttcctaaggttgggagtttttttccttctggtcttaggccagttgccagaggaaaccgatgactaaaggcttcctccctgcaacgtcaacttctggaacctttcctgatgattcctaccagtcaagtctgccttatttggctattttctcccccctcaagttactccctctccttgccaccccacctcaactagtcctctgttctcctttagtacagggaatgccttcttcaagtttatacaataccacctgcaaacttcttttcttcttgtttagagtcctaatataggggaggagtggggaaggagagaggaagatgggagagctctggaatgactgtgatttctccaccctgctttcttatctccctttatcctcttggcactgcctggtcactcctctacagcttcttacctagatctctgacagcctaggagtggtctcgattggcctaaagaggttcagagtgtgggggtgggatggggctagggctttcagcatttgaaactatttctttggagcaggtaaagccttccagttggtaagtctagttctttaagtatgcctgttgtatgcctagccttctcacttggctttcctgggtgggctgagtctaagttccctctacctccccttcccagtcctgagctgtctaactttaggttagaagagctgagcttttgacacttacagcttggggcacttgtctgggtgtctttaaaaataccttttagtaaaaaatggtacaatggaaagaagagtgagatatttggtttttaatctctgcctgtgtgaccttgggcaagtcacttttatgaggcttaattttcttatctacaaaatagagacattggctttttctgacattctgattatttgtgcccagtctttaagaggctaggaaaggggtcttggaaagcgtgtagcagagcagagtggtgacttttcggagaagcttccttttcccatttagaatggcattgagtgtgtcattttctcctctggctatcaacatgtaagcagccccctctatttcagtgagctctgctctgggatatactgaatctacctaccagagagctcactgtggagattctggcttggagagacaactgttgactacatgccttgggtggggtcttggagtccagcctgcagactacagttgctggctatttttggtcatctgtgactcaggaagaatagaagacccttggattggtcattgttccatcagggaaagggaagacaaagaaacaagctaaaactgaggacatatgagatttcacttcctttactccctcccccacaacatccctttttgtagggctatgaaattgcttttgactgagtcttaaattgctaagctccctttccccttcctctatctgaatcattgttgactatgttgcccttggacggggagagctaggtgatatgggcttgggtggagcaaaagggagaatttctagtcaggaagattgccacacacctagtgttgggctttcaactgatcctgtattttgtaaatatggtttcctttggtattagtcctggagatcaaaggagagggacttctgaattttctgtgagggcctacaaggctgatagggaataagcaagtttatgggaaaggtgtacccttcactggatctgtttttacccatcctctacttcttcctccttttcgtccttctcactgacactttatccagtgcttgcttgtgaaacaaggatcccacattggatctcagccacctaagagttggccatgaacataaaccttacctgctctgagccccctggagaaagcacaagaagtcttggcatctgttttccttcctttagaaacaagttccttgggcatccttgggcagtttaaccagagaagccttagttgggtagtgctgggcagtgctgttagggggaagattcttctccagcattgagctggaatggcctgtgggctatgcaggagcttgctgctggaagcagctgccttgctggaagcttctcattcttcctaggtacctcacatgggttgttagcgatgccagttgtaggtggtggatcaaaatggctgttggtttgggaaggtaggcaagcaggtggaggaagaaggaatgtagagtcaaatggaagaagagtggttctttttttatatttcccctttttttaaaactcagcatggcatatgacaaagtttagcaaatagagagagaaattgtgtataaattcatcattttaacatggcaataattatttgtatttcttgtcgtatctcatatatgtaccttagtttttggtggtgcaatcatagtgtacataaaaaagttctccttctttccccctacttaacacatcactaaaaacttagataaatgctatttaattttaagaaatgaacattctaatggccatgtaaaattctattcaaaggctatgccataatttaaaaccattctcctttgggggagcatttagattactcccagcatttgctagtatagatacattcccatgaatgtgaaaagagaaaattgaaacctcttagcatagcatatagggaggtccctttggtacctcaccccattctagcttcctctcccaactcagctcccatttattcccacatgtatgctatgtggtagctttgtgggcccaaggtttcccaagtccaagtaagctatacccgtcctttttctttttttcatccagctttttcaggttgaatttgttttgttttgttttgtttttttgagacagagtctcactctgttgcccaggctggagtgcagtggtccaatcttggctcactgcaacctccacctcctgggttcaagcgattcttgtgcctcagcctccctagcagctgggattacagggatgtgccaccaaacctggctaatttttgtatttttttagtagagacagggttttaccatgttggccaggctggtcttgaactcctggcctaaagtgatccacccacctcagcctcccaaagtgctgggattacaggtatgagccactgcacctggccatgattttttttttaactgtggaaagcaatgccatacctcttctttctgctttagcctatgttctttccttcagcttgaaatttcaggtgcctcttcttcatctcccccccactccatgtcacttccattggaaactttctttattactcccagatagtattgtactatcttctatgtgcccactgtactttgtaagaacttctgttatgttatttaccatgcagaattgcagccatctgggctcctaggcttgctctttcattaaacgtgtgcatttggaagcttctagctcttcctgtctcaagaaggggccattctccaggtggaggtggttaggaatggacaaacctttgaggagcatttggtcagtaatatacatggtgagggagaagcagtagcaatgaatgcaggggatccaacagtgttggatgagcacctggtagggcatactaaccactagtaatagagaaaatacaccttggagaagggacaggtgtattagcacctatggggaagagaggcctgagtgtaagtacagagaaagcctagctggccttgagtcaccagtgcaaattctgaaaccattccagattttagttccccatctgtggaatggaaagagtaatagcaacctactttttagggttatgctgaggattcattcagtgcactaatgcatctgcaagtggtctgtgaggtgtgaggcacaaaggaaggaaggtaggcccaggacactccagtatgtttgttccagttggccttttaaagttctgtgctatatgtgattccaatcaagcctctgaacccagaatgccagatgctacagtttctctgaaccccacataggtgcccctacagccagttttttattttttttttaagtaggaagtatgcagggaagtaccatctcctcactcatttgagcagcctgactccaactggccctagcacagccctactcaagaatgaccacaagtgcctggggagggaggggccaccatcaccttagctctttagtataaaataagtggtttagagtagagggtttcttaacatccctttagctataggtagaagtgtagaagctgcagtgaaactgagcacctttcaggtcttctggtctgaagcctgccatgtactgtgggaaggacagatcttcatgtctgtcactaactgtatactctttagaggcctgcccatctcatctgtcttaggaaaacagttcatgaagaaccatctaagccaaattcaaggtctttgagtggagaatctcaattaattgctttttgttttcaccacatactacccatggcttcttttgttgtttttattgttgttgttgggacccttggcttcttgctgctgccttggccatttgcatacccccattccaccccaggactttatgttttgtaaggaagcaaattacctgagccagtggaagatctactggtcacctataaatcaacacgaagaagggacttgctcaaggtcatgtattgaggcagaagcagaaactggtattgaaggcaagactctcaggagtgtgttctttccattatgtcagtctagcccactagtgtgtaagcttcatgagaacagagatggtttctcaccacccattatatccccggtacccaacacaatgatgcctggcataaagtagattctcaacaaatatttattgaatagatatgttaatagctactattttcatgttggaactgtcttctttagattcctttagctagatctaccagatagccaaacaacaattccattgatccactggaaactacctaatgtggacccagctgggccctggcagaatggaacagggtagcaccggggaatgggaaggcattgtctctcttgtgcaccttggagagactgtttatctgtgagtggccagcatgttcatagccatttctgctcccttttcccatatcttcacataatacagtagtgttcgtgtcaagtgggaatattcaaatcaaaactttttgtggattctaacaggcagccatgcaaacatttctgtccacctttgtgaagtagcccaaagtttggctgtacagtacatatttgagacattactcaatttttaatttttttgtgtttgtgctgctcattatggcatggccagcaggcagggctgcattgcataatttaatcctgagaggtttgtgcacctgaggtttagggatttggttggcccctgtgctgaggcctaggaagagacaggcatagaccagggaggatagcaaggaagtcctggcgatcataatgttggggcatccagtggatatccactcttgctattgctactgttgccgccgccgccaccaccaccaccaccaccaccaccaccaccaccaccaccaccaccacccaggctgctttagggcccagagctgcttatctttgcagacttggtattttttggccaaggtagactaattttgggggcagtaggagatattttcctcccatccactcctgagaaaagggtagggccagcatttgagaggtgtaggtttatgcttactaggtaaggttgactgtcctaaaatagagagagcttctgaagttcacctagtctttaaaggacttttcccatctgtttttttagtcctgagccatataaggaaagttaacagacacaatctctgctgtgtggtggaacagatttaaataaatacagactttgttttacaattttggattaatttttcattatgaaactaaacatgtttgttgtaagaaatgaaacagcattgaaaaatataaagcctcctgtcttctgcccctgactgtattctccagagacaaccatcattaaccagttagttatgtgaacataaactcttttttttctttctttctttttcttttttttttttttttgagatggagtcttgctctgttgcccaggctggagtgcagtgatgcgatcttggctcactgcaacctccgcctcccaggttcaagtgattctcatgcctcagtctcccgagtagctggggttataggtgcctgccaccatgtccagctaattttttctatttttagtagaaatgtggtcttgccatgttggccagcctggtcttgaactcctgacctcaggtgatccacctgcctcggcctcccaaagtgcggggattacaggcatgagccactgcgcccagcccatagactcttttttcatgcatttgtatatatatgcctttaaatgcacagatagtacaaatccgtattgttctgcttttttaacttagtatgtgctggccatcttttaatgtcaaatccgattttaaagtctacaggggctcattaataagcaaatcagcaaataggtagaacactttttaaacattaaaatcttttttttcttttttttttttgaggcagagttttgctctttttgcccaggctggagtgcaatggcgcgatctcggctcactgcaacctctgcctcccgggttcaagctattctcctgcctcggcctcccgagtaactgggattacaggcacatgccaccacgccagactaattttgtatttttagtagagatggggtttcatcatgttggtcaggctggtctcgaactcctgacctccagtaatccacccgcctcggcctcccaaagtgctgggattataagcgtaagccactgtgcctggccaaaaaagcttttttatatagagacagcgtctcactctgttacccaggccggagtgcagtggtgtgatcatagcacactgtaacctccaactcttgggcttaagcagtcctcctgtctcagccccctgagtggctaagactacaggtgcattctaccatgcccagttatttttctattttttgtatggacagggtactagctatgttgcccaggctagtcttgagctcctgggctcaagcaatcctatcacctcagcctcccaaagtgttgggattaaaggcgtgagccaccaatgcctggatgaattggtggaacacttaaaatctacacaaataaaggggccatactcttcattaagtggaaaataaagaagttgtaatgaggatttgtctgtctgagagggaaggttttctgaagatgtgatatgtgaacccttctgttgcgatgaaagatgatggtagctgctcccctttctatgctcagtaggccccacctatagagattgctttagatcctgtgtctaaatgagctcagtggagtgattagtggtaggataaacttattttctatgcttagcatggtccccttcctgttttgtggttttgccagcttggggtggtttgattccagacagtacctgactgagaatcctgcacctcagaagacctctggctgttggagctgtctgaggtgaaggaaagaaactttgtgagtgtacatatgtgtgtgtttgtgataggcacatgcttttccaatgttctccacagaagagcagtggaggctggtccgatggtagtgggttaccgatggtactgggttgtcagaacttgttaacattagcatcactgaagtttttgtttttgtttttgtttttttgagacagagtcttgctctgtcacccaggttggagtgcagtggtatgatcttggctcacggtagcctccaccttccaggttcaagcagttctcatgcctcagcctcccaagtataggcgtgcaccactgtgcctggccaattttaatatttttagtagagacaggtttttgccgtgttggccaggctggtcttgaactgttggcttcaagcaatcttcctgccttgacctcccaaagtgttgggattgcaggcgtgagccaccacgcctcagccactgaagtgggtgtacaaccccccactgctaaatttgactggcttaaaaacaaacaaacaaacaaacaaagaagagctgtggaagggcctgtcaattatcagagaagctagattagaatccccttcctaacaacatacacatcaggaatcttgtccaggtggtaggaaagtggaattttgcagagcactcagctgtaggtgagccaccagttgaataattgaggaagatagtgatttgtgaaatacaaatattttgaaagaaaaattctagcctagtggtcactggtcctggtcttagaagctttctaacttgagagtattgattatgttgaaggaaccaggccactagaggagaagcagaattaccagaaatgctggctctattctgcccactcatggcaggccccacctttctcttgcctttttattcccagacttccacagttggtggggcagagttctgcttgcccagcctttaatcctggaacctctgctaccagaggttgaccctgactgggctaggcccacaggccactgcaggcattattcccttccccttcagacaaacaggaagctgcctgcacactcttagtgattggcactttcaggagctttgtgaggcagggagtttgagatcaggttccaaaaggaaaaggaaatgacattttaaataattttttgggctacttgagaaggtgtggatccaaagtatctccaggcatttattgtaggccaggcttgcaggaatatctgtgtttccatacttacttgctgtttgaccttggagaaatcccttaacctccctgagcctccacttctcccgttggtaaagtgggaatgattatgtgttaacctcagaattggtgggaaacttggataagttagcagtggaaggctctgaaatgttagctcgtagaaaatcaagtgttcaggattcaggtgctcagagaagtttaaatcatgttttaatagtctctgttgacaaaagcagtagagtatatcagtagatgaaagactttcagctcaccactaagaatagttatgatccttaaacgggtgagcctcagttatcagaaaatgttcacttctgtgatacagctcatttatagaccatttaggaccaatgaggcattgccatataatcatctctcaaccatccataataaaactctcttctcggccaggcgtggtggctcatgcctataatcccagcactttgggaggctgaggcgggtggatcacgaggtcaggagtttgagaccagcctgaccaacatggtgaaaccccgtctctactaaaaatactaaaaaaattagctgggtgtggtggcgagtgcttataatcccagctactcaggaggctgaggcaggagaatcgcttgaatctgggaggcagaggttgcagtgagctgagattgagccactgcactccagcctgggtgacagagcgagactctctcaaaaaacaaacaaacacacaaacaaacaaacaaaaaaatcccctctcttctcagctacctgtggactgcctgttctaaataatgtgagctcagggaatacaggctcttctgataatccaaataacacataattagttatgcaaacgtgtcctaaaagtttccagggtgaagtggttaggttgctgttgctgagtaatccatagagtattactcttatgttgatgtgggtaactgaccttaactataaggaaaatggtgaactttgcactctggagcaaggaaagtgataggcttctacttctcaggtcatttgtgccttcactgaccatccctccagctgtgaactcaggtagaggcagcatatttatgagaatcggattagaaaggaggcaatccttcaaagatcggaggttgagaagacatgtttgagtgtgccctgcatggacttttattccagggagagtcgagtagttctcccttcatcacactctactgagattgtcctttggcaagaagaaccaagcttaaagaaaatcttaaaagagccattaggaacctcttggggcaagttcttctggaacctctagctgcttaacatcccagaaaaagaaattctagggttaggaagctggaaaggatttataattttaggggatagctgcccattttccaaatagttttctgtttaaaatagccaagtcagatgcgaattgaaggaatctcttgacaggttggctggcattgccctgtaatttttttccagtgtccaagtaatgataattctctatatttgtaacaagtttcatagttgtaaaactcttttttattgttattactatgtcatttgatattcatcaactctctacagttggcaggttaggaattattatcttttttaaaattattttttaaaatagagacagggtttcactgtgttggccagcctagtcgcgaactcctgggctcaagagatccgcccacttcggcctctcaaagtgctgggattacaggtgtgagccaacacacccagccaggaattattatctttacttttacataagggaaaactggggctcatagactttaagtggctgcaaaaattactcagctaatgagtaatggagacaaggcttgattgggagacagaagactttggttttcgactatgcacggggtggagtgtgggaagggaaggcagtgttgtttcataaaggcctggacttaagctctggtcatggttaggtcagagttctgaagctagaaaggaagtttcagctttaaacatttggcccttcccccgttccagtggttgcccaacctcttttcagtctctcttctaaatattgtaagtcaagactaatgtttagagagagagcacttgggggctgtgtggggatggccacctgttatatttgtgtcctgcctacttggggcctggcctgactctggttttgcaactggcttcctgtgtaacccattcttggtagtgtcagaccactgccttcaaggctaattgtgctttccacctggttgagccaataacttattttgttttgccatgctcctggacatatgggagttgcttattagtaggtgagaattgtttgggggctgcttagacctagctaatgtagagtcttgtttgtaccttggtgggagcaagagcatcaatccaactttttgttgagaggaagaggtattggagaatcatggaaaaggcactcttttttagttgaagagctgttgtttatgctgggccttgctgttagctttccagagcaatcttgaccaagtccttgctcgtttttgggccatagcctgttccacaagaggttggtttggctaacctctgagggctatttcctgctctgaaactctgatttattcagaaatgttatactcccctaacaatggaggctggtctgccctcccatgggtacgggaatggtggcacacatctcagaaatggttttgttctgtgcggaactgagccaaatggacaactctaccagctccaaaaagttggaagtggtcagctgtgtctgaattttgtaagggagcataactgggtggaggggtgaacaggcatcattagaggccggatgtggatgaggagggaagaagtgccctggagaggtagttcatagagaacccaccagaaacaggtgataagctgacatcatgaggtagatggtttatcccagtctgtggccaggtagttcctggtcacaagcagttggtacgccctcaggaatgtgataccatcacatgggaatgtgtcactagagcagccaaaaggctgtggatgcaggaagagcagctctctcttgtcaccattccctctgtgaagggtgggagattcttaaaattgggccatagagaccatatgtggcaaatgaaaaaaacaattcacaatggcagataggactggtcctttagagaaaggaaaagttgtaatgcttgcctgatgtcaaagcatgtggggttggatttgctagttccaatacattttaattttttttcttgtggacttgaagcaaggtttggaaaaagggggaaatttgaactcatgacctttggaaaccagaatgaagcttaatgttgactgttagagctgcccttcttatagtagggggctgagttttgcatggagccatctaggctccctgccttctgatctaccttggccagggtgtacctggggaagtccagcttgcctgtgtaattgatcttgaccagtttgtaggagcacgtgtagactctgattaattggtttgggttaaggctttgggaatcaatattttctgagcactcccacagggaattctaacattgggcaaaggttgattactgcatctctaatagaagcctctccttgctacatgtgacaaaactgaaccagagaaaggggagggaggcctgtgcccatgtcaatatggcatggatacagctgatctgagcactgagctaatgctttttccagggctctttggactcttctaacagttcaattggacatcctctaaacttggtcagaggtccagaaggagatagtagttatggcccccaacccaaaagtgctggaggaaggggtggggttaactaattgcacccaagggaggtgagcagccctttttagagagtgagttcaccgtctgggcgtgagcagaccagtggttgggggaaaggggaaggatagaacaggataggaggtgagtaatgctgtgggcatcaagacattcagttagtgggaacattatagggagctggtgagctcaaggacctggtgacttcactcctcagatccatgtggacttgcagggctggagccctgtctcagtgtccaagacgtgtgtcttgtgcctgggaactgaggactgcttgttctctgcttcctgcttcagctggatggcctttacgcttgattagggagtgagcccagccatagagcagcctctccttggccccagcccctactgctactatcctttcagagtggatcaagctctcgcgcatattggggcacactgtatcacagtgtggtctttgattatttttccactgttttacatgtagtatcccgagtagagaataagctccttctatggtaggaaagggggctttgttccaagtccttcctaggggcatgggaaggtgcttaatggagagaagcaagcagcatgagtaggacactttgggtttcttttctctcgccagtatcaaaaggaacttttcttaggagagaaaggtaactgggagctttagggtggatatagtacacacttcattctctggggtccaagaattatgtctttttcctactaggtggggaaccccttgaagtagtacttggcatagtctctgtattcccagtgcagagtaaaataccccacactttgcaggggttcaatagctgctgaattggtttaagggcattttttgtcttatcctctcccttgagtcagattagattccccagaagccccctatctcctggctgaagactatggaagctaacaggggaggaaaggaagggctgcatccacagttggctgtctggcacctcttggatccagaaatccacctataattcttagcagtagttaacttttcaggtgtatatactttcacatgtagatgttttttatttctttttgtttcttttcctttttttttgagatggagttttgctcttgttgcccaggctggagtgcaatggtgcaatctcgacttactgcaactttcgcctcctgggttcaagtgattatgctgcctcagcctcccgagtagctgggattccaggtgcccgcctccacgcctggttaattttttgtatttttagtagagatggggtttcaccatgttggccaggctggtcttgaacacctggccttaggtaatccacccacctcagcctcccaaagtgttgggattacaggcgtgagccactgttcccggctcttttctttttctagaggaggaacaattgtgaagagccagggtgggaggttagaaggtaggcactcctgaatggttgtttcttcccaccacttttgagagaagggccaagcagatcatgaacatcctagacttagtccagaggagaaaggccttagtgtagtgttggccactaatggaggtcattagccgtggagctctgtggtggccttctttcattcttagcctctcactcccattgagtttggcatccttagcttgatttccttttattctccaaaccttttctgagggaatagggagagaagcaaggcacacatgttcctttgcttcttgagcccttaattggccagctgggagggatccccttcttgcttctttcttcttcatgcatgcctgttgctctctaaggtcagggatttgagccagaggcctgggagtcaggtactttatggctcagcccctggcctggggcctcctattgtggggatcagcttggcccagggccttcctagtatgagaatggaatgagcttttgtggaagatggttagtggtctaagcttattatctattttttctgccagtgcctttgcataggaagggagtaggctgctatgtatgatcaattggtatgtgggccagttatctttggctaactttcagataaaacctttgctgtccatcttttttggaaagtagaatgtgaaaagagatatttatccaggtttgaggccttgcagatagtcagtggagttatcagtatttggttaagtctaggaattggtgaacttgcctgttggaccagtttttgtatgtatcataaaaataagttttaccattttaaaaacattttttgtttgtttgttggtttttgtttgttttgttttgttttcagacggagttttgctcttgttgcccaggctggagtgcagtggcatgatctcggctcactgcaacttctgcctcccaggttcaagcgattctcctgcctcagcctcctgaatagctgggattacaggcgcccaccaccactcctagctaatttttgtatttttagtagatacgaggtttcgccatattggctaggctggtctcgaactcctggcctcaggtgatcctcccacctcggccagcgttgtttttttaaaaaagaaaaaagaatatgtaaccaagactataagtggcttacagagacagtttgccaatctctgctagtctgtgctttagactgccaatttattgtatacctatttcttatatactcatggcttctttatagtcacctctttcctgatccagacacactgcaggcctttgaatcctgcttcttgtagccaatcataaataccttccatgttggttactaactaaccaaaccattgtgtctccttccatgtatacatggggtctgtggtcacctagggttagaattaaaattgtacttttcaaaaaatcagctcctgggttcattgattttttgaagggttttttgtgtctctatctccttcagttctgcactgatcttagttatttcttgccttctgctagcttttgatgtgtttgctcttgcttctctagttcttttaattgtgatgttagggtgtcaattttagatctttcctgctttctcttgtgggcatttagtgctataaatttccctttagggactaaagaatatttatgagtagtcaatgagtgaggttggcttaaatggttttcaggtgataattaatggtgagcatcctaagtagagttgcctcaggtcttcctgcgatttttttggggggcctagagtctcatcaacattgctcaagttgattcaagagaaaggagggtggtagttataagataaatgacagaccaaatattagaatcattttaaccattatttattgctgcatgactttgggtaatgtatttaatgtctctcaaccttagtttccccatctttaaaatggaggatagtgggccgggcgcagtggctcacgcctgtaatcccagcactttgggaggccgaggcgggcagatcacgaggtcaggagatccagaccatcctggctaacacggtgaaaccccgtctctactaaaaatacaaaaaattagccgggcatggtggcatgtgcctgtattcccagctattcgggaggctgaggcaggagaatcgcttgaacccaggaggcggaggttgcagtgagccaagatcgcaccactgcactacagcctgggtgacagagcaagactccatctcaaacaaacacacaaacaaaaaacaaaaaaaaaaaacaaaacggaggatagtactgatacctacttcactgagatttatgagagttaaaagagctcaagagtatgagtatatctaggagagtacctggcatattgaaagtgcttgataaatggctgagttccctaagtcttttccatcatactttgccctctttaaggatttgagatcaaataattttagaaccctgaagtctgcttttaatttgtgagtgtgcctcctatactacattatctctttaagatttttttttttttttgagacggagtctctgtctgtcgcccaggctggaatgcagtggcacgatctccgctcactgcagcctttgcctcccaggttccagcgattccctgtctcagcctcccgaggagctgggactagaggcatgcaccaccacgcccggctaatttttgtattttagtagagatggggtttcaccatgttgtccaggctagttctggaactcctggcctcaagtaatccacccgcctcagcctccaaaagtgctgggattacaggcgtgagccaccacgcccggcactctttacggttttgttttaatagatgaggaaactgatacttcaaacagtgatgccaatgactggcctagtttgtggtgaaacccatcgtgccttctgctgcaatctgttggagggaacggttgtctgagaatccatgtgggtgtatctatcactttgtaaagaggaactccagctctgggaagccttaaaagtcccaggatgagggagtagtagaaaaggagaagagggacatgagacccagggtagaaaggatggttatggggtgtgaagaatggaggatgtaggaaggagaaaatgattagaggaatccttacttaagaaggcaaaacagtttgtgaaatcaatggatctccacccctttgcagaagccaggcagccttggctggggcccacctcaggcccttgttatgctggtagctttcacttcttctttgtgtgtgtgtgtgtctgcgtgtgtgtgtgtgtgtgtgtgtgtgtgtggtggtggtggtggtggagtatagatgcagagggatcttagtttggttgcctttccaggtctatctgtaggtaggcaggttatccatgtgtattgaaagtatgttgtcgggccgggcgtgttggctcacgcctgtaatcccagcactttgggaggctgaggtgggtggataacctgaggtcaggagttcgagaccagcctgatcaacatggtgaaaccccgtctctactaaaaatacaaaattagccatgcgtggtggcacatgcctgtgatcccagctacttgggttgctgaggcatgagaatagcttgaacctgggaggtggaagttgcagttagccgagatcatgagatcgtgccattgcactccaggctgggctacaagacaaaactctgtctcaaaaaaaaaaaaaaaaaaaaaaaaaaacaaagaaagaaagtatgttgtcatgggctccctcaagtcctgaagagtgattcctctgaggtctgtgtgagctagggtggggagtgctcattaagctaagctggtgcctcagtggggctgtgggaacataatcagcttcttatctttattttatacattagtctatcttgcctggctttgtcttcagggatttctgtctctgattgtggcccatctcccccaaatctatgagctggcacctaatgccaaagtggtgggaagatctttaattcattttcttctgataaattctgggaagagggtcaggaagctgggaaaggagacactgatatttaacttcatgcctttgagagaaaggcatactttgtgtttcttacctctgtatccctgtacatgctgtctctctacccagaataccatgaggttccttttccctttaatctttttcttgtgacagtctcctttgtccttcaggagaggtcagctctatctcaagcaaccttctgccttctcacctccccttgtctcctcaccttccccattatggcctggatgcctcttgcttgtgtttccacagtccactttaattacctctatctctgcccttgctgtatagaatggtaatttctcatccatttatctgcatatttcctccatctgacaaaaaaatgccctcacgtgcttgctcattcacacacacacacacacacacacacacgaattatttcaaagcctgatccgatccatattgggtgtctgataaagtggtggtatgtagaacctgtatgtgtatacatatgtctgtgtcaatgatgtgggttctttctgaaacacctgaggtaggtaagaggtagccttacttgtttttccagatcttgctagaatagtagatttttagggtttgctttggattatggaacaatgtatgttgccttgaccattagggaggcttctgggtaatttccatagagattctggttggcctctttactgttgtctgaaaaaactagaccaaacattcggggctgggggtaggattcttattctctccaaagaactgatatgaatatgtgtgtggggggctagataggttcatgctcgctcacctcagcattgaggggtgtgaaggttatatgtttgtggtggtaggggtgctaaaaacccttgtattattgcaggataggttaaatagtttttactagtctcagtaaattgttagctgagcttgtggtttggagggaaagatgtggctttatcaactcgaaaaaacaaagccagcttttagagaagttacctcaagctacatagggaccaaaactaataagctggatgccatgtggtctcttatcttatccttgccaccaagagactcttccaaaacaatcatagatccatacagcccaagagcattctttgggctctctgaacctctgcttccaggaaggcggtcatacaaaaatgaaggctgtgagctaatggctgtaaacaaatacacttgcagcaggttatgaggccacctttcaaccttcagcacatccactggaggtaggtatttttgagactactctcaaaaaattttttcttaaggcctacgtgataaaccttgttccctaatggggatgagaattggattaggctgtaagattagcctaggggaacagcaggctgggtggggggttggggacatcctgcttaggggtagccagccaaagtcccccatacaagcccaaccaaggatcatgccacattgaaggtctgcacagtagtgaggcagtgctgtggaatgacatctgccttccaacttcttacgtgagtaaggaggctctccctgaatattcagatggatgttcagccacattctttgctatatttatagggtggggagggaagacaagggggagccagggagtccgagctgtttagagaggagagaaggaagtttcaacaatgggtaggttcaggctgtggttcctcctcactgccccttcctctttgagtttgtcaggggaccttcctatggcctgagatcattttctttttcaaagtggccaaagccactgtaggcacatttaaatcagggtgctttagcagaaataccaatgctggcatctaaaacccatgtgtagtgagacttgattgacatttgggacctttttaaaactgtaattttattgtatttttgcatttcctggtttgttaatcaaggaagaacattggcatgtcatcttccagtctccaaatgtaagttaaattgtcaatttgtgtttttccagaaaatttctttttccagaagtgctttgaatcatgatcatctatctgtaggcatggatcctccaatttagaagttgctcctagtgttacctagttacccttcctgttccattctgtgaaactgggagatttactgtagattattcagtctggtcagacagaaaactgcagctccctccccagtcaaccaaagcctcctctatggaggggaggtatggtaatgacattatctttccttaggcagccgcgtgttctctgagaacaggatgtggggagggctgggccccagtcacagggtatgggggtgggcaccggaaaatgggctggtggtaaggccatgaggattagtgcttgccttcttggctttgagaggcatgaagagctcctgtattcttgattgttcactcatgtgtacaccccaccctcgcacatggcatgtctgtgttcttaccctaagaaagactgtacctgagaaacaccttgtgtaagagccccagctgtttggcttgcagaaactcagtgaggtggagtgagtgggcccaggctgctcactgtaccaacccatgccttgtgattctttatgacagcctgtggcttcaggccacttttgctaagctttattggggagctgggccccagtagataatgggcagctttgctgctctttctcagggccccagttgtttccctccccacaaatggctccttagctgaggtgatttgcatgttcaacttcctttcaggccccatccttctcttctccctgccccccactgcttctgctggggacctgtggtgatgttctgcctggggtggggaaaagaggatgtagctagcttcctgtgcaaaagagggtggggcgccggccttcctgcctgtctgcccacccacccagtgcttgaggaattgcctgaagagttcagttcagagtcaccagagcctgaagggctttcttcagagtagagattgacctttgctcatgctggtctctctccacagttttctactgtgggaatagctggacacttttttcctgaaatcgcaatgctgaaaggacctttagaggccaactagaccaaccacttcacattacagatggggaaactgaagcccagaaagtcatataagtcctataaggaatcagtggcaaagctaggatgagtagaattctagaaggtcagacctagggctctctccctcccgtcaagctgctaatccagtgggttacaaactgtttggctgggctacctggtgagctacagcctcccttcaaccagaacagctctacttttacgtacttcatattttgaagttttgtgtgattttctgtttgggagattgaggaggcaggaagctgttagaaatgtaataaagtcaaaaccactgagcaaaacccagccattacagttgggaacactcagacctacagggggaagtaaatatccgaagtttactgggattggactcagagacccaatctctgaaccaccattcatggctggttgctccgagctaaagatgtggctccttctaccacaagggctgttcccaccctgtgttaccaatgctattctcctttcccaaagacagcctcttttgtagcatcctaagacagacctgaagtccagaggctgctcaatttcttggatgaaacaaatgataagccaggagcggtggctcacgcctgtaatcccagcactttgggaggccgaggcgggtggatcacgaggtcgggagatcgagaccatcctggctaacacagtgaaacaccgtctctactaaaaataaaaaaaaatagctgggtgtggtggtgggcgcctgtagtcccagctactcggaaggctgaggcaggagaatggcgtgaacccaggaggcggagcttgcagtgagccgagatggtgccactgcactccagcctgggcaacagagcgagaatctgtttcaaaaaaaaaaaaaaaaaaaaaaagacaaatgataataggcaagcctttggaaggacctttgtgtagccttaaataagataaacttggaaaggtaaagaacagaatactagtagttggggagatcagggttctagttctatttctttcacacttgagcatgttgctttttaccttactgaacctccatttctcccttctttaaaatggtacttgtctcgggcttgtctttttcttacagggtttaattcagtgagagaatgcatatgggcaagtatcttttaaattgtagagcactgtgcgcatggggctaggattattgttgtatacaagtgagccagagaccctggaagaatctgggttggataatggcattgcaggagaaaggaactaaaatttatgaaacatctactacatgccaggtaccaagccaggtgcttttctgtttgtaaaggataaaatgtcagccttgcaacactccggtgaggtaggcattattactcccattttacctgtaggaaaactgaggctttaagaggtctagggacttgtaatgttccagagactacctctagagcccagggtttctgtcaggtatttgtgaagagatcttaagaatgtcctatggtttctattggggttttctagcccactccctgcctcactccagcctctctcctctggtggggatgagactgtctcttgttggcttcatgtctcagtcctgaactctttatcctcagatttccttggagtgcactgggcacaattaggtgcccttgtttggcctttagctgatggggagccctttgggtcagccaccttttggctgatagtaaggatgtcctgctaccctggggtgctggtaaggagagccagggatttatagctagccagacagacttggctcttggtcaaggtcatgcagctagaaaatagcagttggttcctttctttgagactcagtttcctcattcataaaatgggtttaataatgcttaacttgcatgtgtctcttgtccagtgtgctggtaaatgtttaacaatcaactcttcggcaaatccatgatttttactgtttgccaattcccatggtataaatactcccaccatggctgatttcaggttaccaatatgcagtccttgatggaggagttgggaagagatgtgcatgatcagctctagtgcaagctggttctagtgcaccattgctagtcacacctattttagactcctaccctcaccctccaacatactcacatctgtatgcaaatgcagcatcctctcaaccatgcctcttcttttcctcaagttccaagagcatcaaggaaagagagagcttcatttaaggtctgctccttgcctgaaagttcttccaggaaagagtgaatgtggagtgtttaagacgcagagaactcaagagggctttgagtggggccctaattatagcattgtgatcatcatgctttggctgctgaagtatctgaactgtctgttttctcccactgtttgattcttagctagatgggaggatggttgaagatcctggacaatggtctgagggtctggtgcacttagcgttctgattgtaatttcaaagtctcctcctcttcctgcctgcagaccttactttgctgggtgctaacctcaaggttcctgtcatggggatctctgggccagaaagcattttggatgaccagagatccctggtcctgttctctcatttcaacagcatcaaggccatgtgttgtttctttgaacttttcagatggaaagaatcacctgaggcatttgttaaaatgctaattccccagcgtcttctctggagagtccatttcagtaagcttggggtggtgtccagaagtctggactttttgaccagtgccaaattcttatggtaagctaagtttgggatatacctcattaagcactgcacaacactcctgccatggtggcatcattatgcccacgttacaagttgaaatttaagagttcatggtttattattggtagacctggatcttgagatcaggttttcagaatacaaagctatgttcctcttactacagagacattactttagtgcacagtggtgtatgtgatggtgtgtagtgatgattttaggtagggaggagcagggataatccctgcactactttacaaatagggaggccaaggtgcagagggatttgagggcagtagcagaactgactgcatccttgcatccttgatcttttgtggatgtggaccgtattcaattggcttttttttttttttttgagacggagtcttcctctgtcgcctgtcgcccatgctgcaggacagtggtgcaatctcggctcactgcaacctctgcctcccgggttcaagcgattctccttcctcagcctcccaagtagctgggactacaagaatgcaccgctacacctggctaatttttgtatttttagtagagacggggtttcaccatgttggccaggctggtcttgaactcctggcctcaagtgatctgcccgccttggcctcccaaagtgttgggattacaggcgtgagccaccgcacccggcctttcagttgctctttacttgctgtgtttcccttctatcagacatccctctagtcatattaacaccatcccaggccaggcgtggtggctcacgcctgtaatcgcagcactttgggaggcaaaggcggtcgaatcacttaaggccaggagttcaagaccagcctggacaacagggtgaaaccccttctctactaaaaatacaaaaattagccagacatagtggtgggtgcctgtaattgcagctacttgggaggctgaagcaggggaattgcttgaacccgggagacgggggttgcagtgagccaagatcacgccattgcactccagcctgggtgacagagtgagactctgtctaaaacaaaacaaaacaaaacaaaacaaaaacagtttgtgatcttctggataccatctgagggagtttggaggtcccagtgggttgtgttgagggttgcagacttgtgtgtgttaatgggacataactggagaaaatggcaaggcagagtccagaataaggaaggaagatcaggcagcctttgaaaataataaggcagcataggtgctgtgttgtgctctgcctttccataggattctgcttcttggggaggaaatccccatctctctcaagagataaaatatttaaaataatgctggaatacatgtgtatttaactgttgtgcatggtttcacattgtcttgccaactagaaatgtaatcaccttttagttttccctgaaagtgagagtcctttatgctagaagggctctttagaggtcttcttgggcagcccctagccctctgtagtgaaacaggtttttgttttaaattattcctgacaggtaggatattcgtcataatatggctaaaaggggagggattagtaatcatcacattctacttatgatgtgtcaagtactttcatgtctattattattattatttttatttttattactgttcaattattttcttcctccagtgtcaaacatgtctgttatgttaacttaaatctcccaataaccctgtactgaggtcgatattattagacccgttttatagattaggaaactgaattttagaaagaggaaggtcaaaaaggctccaaagctcaaaatgctgagaccattatttccaggacaagggctcctgggttttctgtgggtttcccagatactagatttggttcttagcttaccagcaaggtaggtaggaagccaaccttagcctacccctggggttgaaaacagaggttttttgttttttgtttttttttgacaggatctctctctgttgcacaggatagagtgcagtggcaagattttggctcactgcaacctctgcctcctgtgttgaagcaagcgattctcatgcctcagcctcctaagtaagtattagtagctgggactacaggcgtgcgccaccatgcccagctaatttttgtactttttgtagagacagaatttcgccattttgcccaggctggtctttaactgggctcaagcggtctgcttgcctcaccctcccaaagtgctgggattacaggcatgagccaccacgctcagctggaaacagagctttttgattagggccagaagcgtccccctgcaactgcatatttgactaatcctggcttcagcagttttaacattcccatgagcaatagatggaacccaagtttgggtttggatcagctccagtgtgcttcagaagtatgatgctggaggttgctggagtctgttcctaagcagagggaatagagccctcttctggcaccctgggcagagctggcatattcaggcagccaaaaatggtcagtttccagtctacaaatacttcctgtaaaacttgctggcaggaagctgggtcaagcaggaaagtgacgctaaagagtgaagcccagctaggtgtggccccggataggggctttgcccatctggagacttactttattaatgatgggtctgcacttcttttatttcagcagctttgaagttttatgggagttgaaggaatctgttgttcttggctgcctggatatgaacccattactcaaattcccttcctctttctctgctctgtgccctcctcaatccccagcttgagtcttggctatgcctattactgggggccttcccaaccagttgctattcaagtttttccaaagaaaacagttctggaaacagggctctctgagttctccttccatggtgttataaaatatttagtctccctagaatgggtggtggtgattgtctcagatcctgaaagttaggcctgccctctgttgaaagctaaacttccaagcagtgccagcttggagtttttcacggaaacaaattgatccagcctcctccacatagttttttttttagatcaataatagtatgcttgaagtatctactgttttctaaatgtcaggctggcactatggcttactaaataggctagtggatcaaaagccaggttttttttttttttttgagatggagtcttgctccgtcacccaggctggagtgcagtggcgcaatcttggctcactgcaatctccgcttcccgggttcaagcaattttcctgtctcagccgccctagtagctgggacaacaggcacacaacaccatgcctggctaattttttgtatttttaggagaaacaggatgtcaccatattggtcaggctggtctcgaactcctgacctcaggtgatcctcccaccttggcctcccaaagtgctgggattacaagtgtgagccaccgcgcccagcctcaaaagccaggtttttagcccctcctcccacactgcctagcagctgtgtggctctgggccagtgcctacctttctttggacctcagtttccccagctgtatgttgcaaggttcgaatcgagtgatctctgacgtctttttcaggtctgacagtttgggattctggactgtttattttcttagaggacaagttgaagttcagaagggagaagccatatgagattctaggatgcatgggttgaaataatgagaaaatgtaaaaagaggaatggccatgctaaggagctggtgtgtcagcccatgtgcctaagaaggagagatgagttggggctggagagtatttgccctgggggtatggtttggctaaggtgattttgaaagtaagaactgaagttaggttcagacactaagcagatggttttcttcctgactttcacgtgtggagagaaaaacaagaggggtttacctgggcctgaggttgaacaaaaggccatgcaattacggctggattaacgaagaaactaacttgctaaagtgacatcactgtttctgatttttttctttcaattttcacctctgacctgaactctgctcccacagggacaaggtggttatatttccattgctaaccctcacacatatggtaattggaggagtaactctcagtttccagtgtgcccttgtcttccagttgaaatgcttcttgaggagcttcggatgacagggctgggtcaaaacaaatgaaaggggacccttgtctctgacgccctctggagcagttggagtggttgaagaaatactgctaacccattaaggtgtgagtgaggttgggtgttgttctcctttctagaagctactgggaaaaggcacaggcataggaaaggttaaccccagtcaggttttatgggctgtattgagagtctggaagaggtcctagcagataactgtaccagttaccacttccaagtcaacagggaagaggctgacttgctgagaagtgagttagtcagtgaaggaagaggaggaggagcagaatggcccctaggctaaagattcaaagcaaaccttgttttccctcttatggaaaaaagctagttgagacagtgctgtcatccagagaggcaaaacagaccaggacctgccctgccctgccttggccccactcttagtagcaggaaatggtgggaactggagcctaaacaatggagtttagcttccgacctgatgaaggcagtgtgagtgacgctgtgatgactattctctggccaaggaagatactagaactctgggattgcgttggtagggcacatccttcttctggctcccctgccccacttatacttgccttcttctctacaccagcagccccactgaaagcccagcaggggtggccccctggggaggtggcaggtggaaatgaggtcattgagctcagacccaactgggctgactcacaacctctgccccagtgagacaaggggaccttcccaagcagtgcttcccagatgtgcccaggcttcctatgccagaatgtttgagtcttagccaaaatagttgccaagccagtgtctgaagacaacatgacaggagaggtgggtggagttgtggaaggagctccaggaatgtccagaagacccgcctccactacttgttggctgagtaaatgtgacctcagtgatgttaagtgagactgtgtgtgatgaggccgacacattgttggcattcagtaagtgttcatttccatccttctgtcacctgcctctatgcacttcagttttctcatctatgaagtggggatggtaatgttcatcccctcagctcggaggtccatgctccaggcaagttacttgtaattatttgacttactctctgcttttctctctgactcttccaaacttctctccaggaaagagccatcttatagttcagtgacatggggtaggtgaggggaaaccattgctaatcccttttgctgtagctgggctacagctcacctgggtgcttctgatgataggcaaagagagggttgcttatttgaaactggcaggcccagacaccaaagtacctctcagctgctggtgccaagacagaggtagcatctggcctggttacttttgtgtctcagcccagctaactggagacatgagagagaacccagtttgttgaaggctttggacagtgtaccaccgagatgagtttgtttgtgcttagtgaagtgcttggtgtgggaagcgtctatgttgaattgctcagtaaataacagtgggcttattgttcttgggcaacaggtgggagggccagtgcatgtgagaggatgacactcctccttccccaaacacacatgcagacattttgttattgttccttcaaaccttaatgttcttctgagacacagtctttaacctcatgctgtgcctagatcctcagggcctggcttaggcagggatctaggcatataaacagttctcttctggggactacatcttgaaatgctaccccatccgggtcagctcctgtattcctgtcaaactgaaggactggctgggaattttctgccaactttggaaacttcatttttaggttctttcctcccaaacaagaccactgtcttctctttagggagagagcagcgtctaggcccgaaaagaagaccatgggtgcctactaagggtgagcatccagtgggccctctgtggcagtgggtctgggcctgcagcccatcttgcactcttgaatccctgattaatctaagagagaacaaagggaccttctttgatcaggacttctatcctatctatcactttcaggccccagctgttactacccttactccctgctacctctgacacgtacacagaaaacaggagagcatagaccaatggccttgtcctcatgacttagtttttttctaatttttaattttaaaatttttattattttttaacttgatttttttttttaaatagagatggtcttgctatattgcccaggatgatctctagcttctggcttcaagctgtcctcccaccttggtctcccaaagtgttgggatttacaggtgtgagctgctgtacccagcctaattttgatttttttaacctgacacatcataataaatgcatacataaattgtacatatttatggggtacatagcagtgttttgatatatacaatatatagtgatcagatcagagtaattagcatactcaccatctcaaacatttatcatttctttttgtgagacagggtctcactatgttgcccaggctggagtgcagtggcatgatcttggctcactgcaacctctgcctcccaggtttaagcgattctcctgcttcagcctcccgagtagctgggattacaggtgtgtgccaccatgcccagctaatttttgtatttttagtagagatggggttttgccatgttggccaagctggtcttgaactcctgacctcaggtgatccgcccacattggcctctcaaagtgcggggattacaggtgtgagccaccgtgcttggcggggtgtttaactttctgtgcctggcttatttcacttaacataatgtccttcaggctcatccatgttgctgcaaatgacaggatttttatttatttatttatttattttgagacggagtcttgctctgttgcccaggctggagtgcagtggcatgatcttggctcactgcaacctccgcctctcgggttcaagagattctcctgcctcagcctcctgagtagctgggattacaggcacacgccatcacacctggctaatttttgtagttttagtagagacggggttttgctgtgttggccaggctggtcttgaactcctgacttcaggtgatctgcccatctcagccacccaaagtgttgggattacaggcatgagccactgtgcctggccaggatttcattttttatggctgaataatattccattatgtatatatgccacattttccttatccattcatctggttttggacacttgggttgattccatatcttggctattgtgatgtagtgatgcagtaaacacgagggtgcagatatctcttggatatactgattttttttcctttggataaataaatggctagtagtgggattgctggatcatatggtagtcctatttttagttttctgagaaacctccatactgttgtccacagtggttgtactggtttacagtgctgctaacaggactcacatttgcttctgagttaagtggagacaggaatgggaattcttttgtgtttgtttttctttccaactttttaaaaacccaaaattatttatctccacattgaagttcaggaaacctcaggctgctatccctggggaagaagccatagtggaatggcagaaaccctgagtagagattcagaaaaaacaggttctggttgggtttcagctcacaccttctgattttagtagagcccttttaccagggtgatcctctacgagggaggaagcatggccaaccctagcctctctgacatgcttattcatcactcaggatgggcccttctttaccaattgatttatttaataaatatttgtttaacgaatatttgattacgtactttgggccagcactgggcttcacccttgatcagtgccctgaagacgctggattggcatgacctacaattgacatgatctgttcgagacactggcttgcttcctttgaaaattatttccaatattgtgaattaaagggaactcctaggctttaggatatgtccctggaatcccacccccccttagtttccttcctgggtgttttcttccaaaaagcctggttctgattgtgccccaccctgcccagaacctctagactggctggccactgccaacaggattaaggcccaaccttctagcatagccttcaatgccctccacttatcttcctagactctgccctctcttcactttgcaggcctcattcaccctggagtaggactgacttctaaagggaccatctgcatccttgcctccttctgggccatcatacatgttgttttctctacctgggacatttgagtgctcttgtgcctaccctcacagtctttcttttccacaatccagcttattctttggaaatcagtgcaaacactactttgaactgtggttcctaatttccacgaaaggttttctctgttcttctattatggcacttttcagggtctcccttgtacattttagtttttgtgtttttcagtaagtgccttgagatcagggaccggttctactggtctgttccaaccatagttccttaaacattgtgttccattaatattgggtgaattgaaatgaatttataggaagctccttaacctggggtcctcagacctctatggggtccatggacagaatttgaagtgggaaggatatatgaacttggatggaggaaaattacttatttgttttttaccaacctctcctttgtaatttagccatttgttcaattataatgtaggcaaataaaaataaaaataaaaataaaataaaggcagcaataatagcagtacccatgaccttgttaccaactcttaggctgtggagtgttttcctggattctaccctttttttaaggtttcttaataatagaagtttatacagaaactatctaatgtacttttttttttagatgaagtcttgctctgtcacccaggctggagtgcagtgacgtgatctcggctcactgcagcctctgcctcctgggttcaagcgattctcctgcctcagcctccagagtagctgggactacaggcgtgcaccaccatgcctggctaatttttgtattattattatttttttgagatggagttttgctctttttgcccaggctggagtgcagtgacgtgatcttggctcactgcagcctctgcctcctgggttcaagcgattctcctgcctcagcctccagagtagctgggactacaggcgtgcaccaccatgcccggctaatttttgtattattattatttttttgagatggagttttgctctttttgcccaggctggagtgcaatgacgcgatgtcaacttgctgcaacctccgcctcccaggttcaagggattctccgacctcagcctcccaagtagctgggattataggcatgctccaccacgcccagctaatttttttgtatttttagtagaggtggggtttcaccatgttggtcagctggtcttgaactccagacatcaggtgatccacctgcctcggcctcccaaagtgctgggattacaggcgtgagccaccgcgcctggcctaatttttgtatttttagtagagatggggtttcaccatgttggccaggctggtctcgaactcctgacctcaagtaattcgcccgccttggcctcccaaagtgctgggattacaggcgtgagacaccatacccggcccctaacatacatatttttatatcacaattagttattgtatatttctcaaaatattatttatgctcaatacacgtttgaaattacagtggcaataactaactaataagacctagtgctcggtaattacttaatatgataataagcacatattattaaattttgatttatatttcaaatatttcgatataattttgttatattgtatctactttatttcatgcatttacaaatattctaagaaggggtccataggcttcactagacaggcaagaatgattcgtggcacaaaaaagtcaagatgtcaaatttccccatctttgtatgtgtatattatgctgtatctatctccaatatcccttgtttggtacccattcatttagccaacatcttgcatgagtacccattgaatcttgagtactggaaaggtaattctaagtaagacgtaaactttgagttgagaatgaagtctattattctaaaaagcccactgccccctttctattctctcctgtcccttcagtcattggtgttttgaggtcacccttgacccagctcaagggtgatttgaggctggatatagtatggtgcccctcaaattccagtccaatggccccatcctactttatgacggcccattctgtaggggtcactgacttggcaggaagcctagggtaggaccaaatcaaagtggctaaccttgccttactcccactggggtacttgccttacttgttcctgccttcagggcctttcctgtcccattgtcaatcctaaaatagatttcctccttggctccctagcgagatttatttacaaagttgttttctgggcctgatcctcatcgtaattgtttatctggcaaaatagctgcctggccccctcttccctgctcctgacccgtgtgttcaggaaagtcctagaggttcaaagactgataaggtttaatgtcttactcactccatggaaatttgcatctttggcaatactatatctagtgctttccctcaatactataagcagtatgtgaccaacttagaaaatgtagattagattttttttttttttttttagtttaaagaaaggagaaagcacccataagatcaccaccccaaaaccaagcctgactaatacttggacaagattccaatcatccttctatgtatacattttacaaagttgagctcacggactctatgaaatactgtttacatttcctcaatattactaaagtgtcttccgtgagcatgaaatagtcttcataaagattttgtatgaccatataagaagccattttgtggctgtactatatacattatttaagcaaaatatctaacaactaaaaatcaatcttttttttcttttaatgggagacttttgtactctgtaagaggaatttagcatattggtttacattgtgaggtttggatttagacctggattcaaaccctgtctcccctgcttaatagcaatgtgactttagacaaatacctatttctttatctccaatgtggagataatactctacttcacagggtgattattgatattaaatgaggtagtacatatgaagtgcctggtgagtagcaagtcttgatacaggaaagctgctgcctgttactattactactgctaccattactactgagttttcagccaaaggactaaatctctaattatgaaatttcagctatcattgacctagcttcgaggatctatttgtaaaggtggtattttttctagtgcccgtgaaatcatgtgtgtggctgtctcttattttggtctgggcctgtttctgcacctttgtcctcccactgagttggctttggtagcccctctatgccacccatacccacctctactgaggcccccttcccctcttgagcctaaggaagccaatgagacataaatataggaagcattagcaatgcaaggcagtatatagaaccaccgacatcagcactgaaatggtctttggaccatttatctagtttaattggctgccctccatcccattcctgcctttgcacaggtaagggaaactaaggcccaggaaaaggacaggagttatccaaggttgtagatttgaccagctacatgctaggcttggaatccagtgttcttctttgtttttaatttttattttaagttcaggggtacatgtgcaggtttgtcataaggtaaactcatgtcatgggggttcattgtacagatcattttatcacccaggtattaagcctagtacccattagttattaaaatattttttcctgatcatctccctcctcccaccctccaccttctatgtgtctgtgtgttctcatcatttaattcccacttataagtgagaacatgtggtattctacaacctctgcctcccgggttaaagcgattctcgtgcctcagccaccaaagtagctgggattacaggtgtgcaccaccttgcctggctaatttttgtgtttttagtagagatggggtttcgctatattgtccaggctggtcttgaactcctggcctcaagggatgcgtccatcttggcctcccaaagtgctgggattacaggtgtgagctaccatgcccagtctggcatttgattttctgttcctgcattagtttgctaaggataatgacctccactccattcatgttcctgcaaaggacatgatcttgttgttttttatggctgcatactaacatacattttctttatccagtctaccattgactggcatttaggttgattccatgtcattgctattgtgaatagtgcttcaatgcacatgcgcgtttatgtatttttatgatagaatgatttatattcctttggatatataccccataatgatattgctgggttgaatggtagttttgttttcaggtctttgagaaattgccacactgttttctaccatggttgaactaatttacactcccaccaacagtgtataaaggttcccttttctttgcaatctcactagcatctgttattatttttttttgattttttaataatagctattctgacttgtgtgagatggtatctcattgtggttttgatttgcatttctctaatgatgtaaattttttatatatgcttcttggccacatgtatgtcttcttttgaaaagtgtctcttcatatcctttgctcacattttaatggggttgttttttttcttgtaaatttgttaaagttccttatagatgctggatattagacctttgtaagttgcatagtttgcaaatattttctctggttccgtaggttgcctgttaactcgatagtttcttttgctgtgcagaagctctttagtttagttagatctcatttgtcaatttttgcttttgttgcaattgcttttggcgtctttgttatgaaatctttgtccattcctatgttcagaatggtattacgtaggttttctttgagggtttttataattttgagttttacattacttttacatttaagtctttaatacatatagagttgatttttatatgtgagataaggatggggtccagtttcaatcttctacatatggctaaccagttatcccagcactgtttattgaattgggagtcctttttccattgcttgtttttgtcgactttgtcaaagatcagatggttgtaggtgtgtggccttatttctgggctctctattctgctccattggtctctgtgtctgtttttgtaccagtacaatgctgttttggttactggagccctctagtatcatttgaagttgggtagcatgatgcctccagctttgttctttttgcttaggattgccatggttattcaggctgtttttttgtttccatatgaattttaaaatagtttttcctagttctgtgaagaatgtcattggtagtttgataggaatagcattgagtctattctatgaattgctttgggcagtatcaccattttaacaatattgattcttcctattcatgagcatggactgtttctccatttgtttgtgtcatatctgatttctttgagcagtgatttgtagttcttcttgtagagatctttcgcttccctagttaacagtattcctagatatttattcttttgtggcagttctgaatgggattgccttcctgatttggctcttggcttgactgttgttggtgtatacgaatgctagtgacttttgtatgttgatttttgtacactgagactttgctgaagttatttatcagattaaggagcttttgggccgagactattggattttctagatataggatcatgtcatctgcaaacaaggatagtttgacttcctctcctcttgcttggttgccctctatttctttctctggtctgattgctctggccaggacttctaatactatgttgaatatgagtggtgagagagggcattcttgtcttgtgtcggttttaaaagggaatgcttccagctttggcgcattcagtatgatgttggttgtggctttatcagatggctcttattattttgaggtatgctccttcaatacctagtttattgagaacttttaacatgaaggggtgttagattttattgaaagctttttctgccctttagattatcatgtggaacccagtgctctttgtcctgatattaatttgcctctgcaattgtttaccagtgctatagataatccaggtagatcagaggtgagaagagaaccctgtgagatgaagctgtctagtatagatggaaaggccttcctggaagaagtacagttatcatttgcctgctcttagttgtaggctgatctgcattcttttttaaaaatttttttgagacaaagtctcgctctgttgcccaggttggagtgcagtggtgtgatctcggctcactgcaacctctaccttctgggttccagtgattctcataccccagcctcccaagtagcttgaactacaggtgtgcaccaccatgcccggataatttttgtatttttagtagagatggggttttgccatgttacccaggctggtctcgaactcctggcctcaagcaatccacccacctcggcctcccaaagtgctgggattacaggcatgaggcattgcacccggccttcatgcttgtctgttctttggtaagtattgctctgtggctgtgttgtttgtcttcaataagctgcttgggagcaggggttgtgtttgggtcaatattctcccttcatccccatcagtatctaagttgcccaggctcttagcatcctaactccttcctctgtggttgagcagagacacttgtctcaggctctgttgaacacagagccagatgactaacctgcttcctttgatctcatcctagatcagtgtgcgtgtgaccaccatggatgcagagctggagtttgccatccagcccaacaccaccgggaagcagctatttgaccaggtaaggcggagactccttagcctcctctccttctctgaatagcttccaccacaatgccaacaatccatgacttttgcctcttgtcaaagaatctctcttcctgttcactccaagatagatcaaaatgaaggctgattccagacttaatatgaaaggaggcaaagttaaactttggcagcctgcaccctatggtcctgattaattttatctttggtcctgaataagggagaaaagaaaatggtgtatattctatgctagatgctttaaaaatcttagcatatggagccttccttttaactctgaaacatgtaagtgatgtcttctccattttaatgatgaggctcagaagttaaataacttaattgcacccaaatgatatttggctgggatttgcactccacattgttgccactgcaccacactgcctctgtcccatgtttttgcttcctagtagaaggaaactaacttactctccctgaggtagtaagctctatgcacatttctctcaaaagaatgttgggacttaggacaacatgggagttgatggatgcagtaggaggctgcttcatctcctacaggcatgccatgaagataattgcttactcgccatagtgaagaggtcattcccatctccaacccaaggggtgtcccttcattgtgaatcattattgtcagaaaggatgtactgtatactataataaacagatggcagctacagacatttttagcattcaagggaatgtgccgtctgtggccagacttctaggagcaaaaatgaggctcccatttccagaggctgggacctcaccagacaggccattatcctatttctccaccagactccgatgaagtggaggtctgagttattgtccaggatgttaggctgcatatcaccctgatggattctccaggccctcttgcttccctttcttccttgctctctgtgtccttctaccatatgagaacttccccagggttggagagaggaagaaaaaaagaaggaggtagtgttcaaataagctaattctattcctgtgaatacttctgactggtgagagaaaagacaagagtagaatggagacaggggtaggagagggctagaaatttgaggacagcttgggtacaccttctgagttcttattacatagagtgggaaaattattgtctgtggctaatacagatgagagttaacatttatccaggactcagtgtatgctaagtattatgataagcatttgactatcacaaagctctgtgagtgcatgaattagtatgggcatgttttacagatgaggacacaaaatcctcattttcctagttagaccctgggaaaattattgaactctctgggttggtatcttcatcccctccccccgagaaatatctaatacttacctcacaggatttttgtgagtgtgttatgttttgtatcttacctgttactcaaaaatctgattatagtggcatataaggatgtccaatccaaaaagataaattcgaaataggtgagaaagataagaaaacacaaataggaaagaaagtgttagctggaagaaagcatccagcatatggtagagaagtaataaatgatagctccctttccaataccattgtgcttcttgtattattaattgagctggagttgacgtgatgtggtggctcatgtctgtaatcctaacactgagatgggaggattgcttgagcccaggggctcgagaccagcctgggtaacacagcgagaccctgtctctacaaaaaatttaaaaattagcatggcatggtggtgcacacctatagtcccagctactcaggagattgtgccaggagggttgctcaagcccaggagttcaaggttacagtgagctatgatcacgccactgtactccagcctaggtgacagagcaagactctgtctctaaaaaaaaaaaaaaaaagtaaagaaaaataatctagaattgggagaattgggagatgggcttaatgatcctcagaatatctaacttcagatttaggtggaacttacttctctggagtttgttttgtgtttgttttactttgaatggcaaagtgtaatcattgatacttaattggtgaaaatacaaattagtctgaggaatatttaaatacaagtttactacaattaaagtgatgtgcttacattcacatagctcacaagtgattatggtgctagtctggaatgactaaatgcattctaattataattgtgctttgcattctctcttcacatggaggttatattggagaacttttaaagggacagcctagtgaagtcaaaagggcctggatagaaagtcatgaatcttgggctgtagggttggctctatcactaattcgctgtgatacaaacgtttcccttatttgggcctcagtttctcatctgtacaatgcctaacttgtttctcaaatctggttatctctcagaaaatttatctctggcatttatttgtgcattccatctctctttctctcccatttctgttcctagtattgggatttcagacaatccttttctgtaaaaaggagagaaatgcctcacctgagtatgatcagctgctggcatatgtgaggaggtagggctagctggcagggggatcatctcttccttgacaggctttttactgtctctaagacaaaagggaggaagtgtccatagaacacataggcttttgggccctttgctttagacagcagtatcattctgggtagcagctattagagagggaagcggttagtcagtgcagattttacagaccagctgggagccagaggctcctttgacatttacctatactccttccaagagccctgattctactaattccccatcccaaaccagatgacgccatcctctaccctcaacactgggggctttgtatatgtgcattgcagggggatggctgtggaggatgaggaaggcatgatttggagcctagtgggggcagaaaaattcttgaacaaagaggtttattaacttcaaaaaacctcaatgcctggtagttttttgttagtgttggtttggtttgtgtgctgtgggtgtggatttgagggaagtccagatagtagggaaccccagatagtagggaaccctgggcagattggtatgctagttctgaatgctactgcttccaaaacaaagcctttgggagacttggaaaccaagaagtccatgacttctcatcattgttatcttgagaagtatcatttattgagcacatactatggcctattcctggctaggcgctttaatcctcacaatgctcctgcctctgtgaggtgaaagaacatactctaggtcatgtagttagtaagttgtgatatggaattttgaatacaactctgatcacaaaactatacttttcctgcactgcactactctgtttggggtgattgggagtattcaacttagagaagactcaaggaagatatgctttctgtcttcagacctctgaaggactatcataagaaggaggggggcagtcacattctgtgagtcagagggacagaggtggaccccacaggtgagaaaatacagggaaaaagatttgaactcaaggaattgagcatttggccctcttgaggccaaggcaggtcaggtcaggaatcagtagagttatgtgttcataggcatttgggggatgtgagctcttctctctctaacttgatgaggcataagggaggaagtccgttctgtctggctcttgggacccatcattcaaggaggccctcctggtagagcctgggcctgggaggaaggagctagactccttggcaggaattggcaaaagctttatggccatcctggaacgcagcagtcatctggccaatgaccagagaggaagccaaccagagaggaagtactccttggcaccagcaataaataataggcaacaatgggatgccatagcttgaggaagtctagggcctggtgggaaagggaagtaggactcatagtttgtctcatttacctctcttcttgtgagtgtgctacagctagaggggagagagaacatgttttgctatagtgattttgtcacttgcttcaacttctaaagcttttgatcttggattacctaggtgccactaaagggctgtgctcaaggacagaggtgaaatctcaaagcatcgattcattcatctatttactgattcatttaatattgactgaaggtctacactgtcgaacaccatctctgttcttcaggaacttggagttccttacctataaaagcatagaaaggcacatgcaactctctacccacaaagaaagaaataaacgcccttgaggtcaggttccatggggtgatatataaagcataggatttagaaccagccctgagttcaaattctgtcctgttacttcgctgtgtgaccttggatggctcatttagcctctcagtactttcctttcctttgtaaaatgataatcatgctaatctcagattttgtgatttaatcctcaaataagtaaaatgcctggtgcataccaagcattctaatattggtggttcttattaaggactaaagtaggtggcattgccctgagagttcagatgagggagctatgaaatcaggaagttcttctggctcagtaaagtacttaggacttgaatactctgcaataaggacagtaaacctttttttttttcattttataaaataactaacatatattatagtaggaggatctccatcttacagatgaggaactgaggcttacagaggtgaaattatctgtttaaggtcatatagctaggaagtggtatagctggggcttaaaccagggcacatagcatttccagtttttctaatgcttttgatcaactgtcctctggaaccttcttccactttacctgcttccaaaacttagaaccctagctaggttgggcatggtggctcatgcctgtaatcctagtgctttgggagtccaaggtgagaggatcacttgaggctaggagcttcagaccagcctgggcaacatagcgagaccccatctctacaaaaacttaaaaattagctgggcatggtggtgcatgcctgtagtcctagctacttgggtggctggggctggagaatcacttgagtccaggagttcaaggttacagtgagctatgattgcaccactgcactccagcttggttaacagcaagaccctatctctaaacaaacaaacaaaaaacgataaaagaaagaaacttagaacctcagctgagtatgttctctgttatagagcaggtgaccacttgaccacaggcaatgtgtaataacagaaacagcaatagtggtagcccatcttggtgctttccagtggtgcaataatttgctttcaggtgggtggctgatgcagatgctgccaaatctgtaatggtatcttgggggtctcaggtgtttgggcattgatgcagttttgcacattgtttctcacacagttcttctcttgtggctccagcattactccctcattctcctctaggcgtgcacgctcgtgtgtgtgtgtgtgtgtgtgtgtgtgtgtgtgtgtgtttggagacaaggtctcgctccgtcacccaggctggagtgcagtggtgtgatctcactgcaaccttcgcaccccacagtctcaagtgatcctcccacttcagccttccaagtagctgggaccacaggtgcccacaccagctatctttttgtatttttagtagagatggggtctcaccatgttgcctgggctggtctcgaactcctgagctcaaaagatctgccccgccccagcctcccaaaatgctgggattacaggatgagccactgcgcccggccatgctctgggcttttgaagtggctgatgacatcactagtttgtttactcagataaatgcatgggggattcaagaagagaatttctgggcttttgaagtggctgatgacatcactagtttgtttactcagataaatgcatgggggattcaagaagagaatctctgggctcctaagctgacctgatctccgctcccctctacagacctcagatgtaggttgcctccacatgtcaaaaggaggtaaagggtttttttttcttgcttccagaagctcctgataattaacgaggatgtactccaaggcagatcttttcttttcactgcacctcagttttccattttatgttgcttgaaccctgtaactctccacagtcatggagctgagtagaatacacaacctccagtttcttaagctagtgtcttaaaaactgaagtcctactttctttaggtgtatggggcaggttccaggagggatacaaagctgtgagatgaatgtggtttagtattctagagcattaattttacttgcaataattttaaaaattcattatttatggagtagaatataaaatttgcacaaataattaaacctgaggcttcaaagaaattatagctgggttacagccatctacctattatctccccctaccccatcctaccacaccccctatgtcccttgggtatatgcattcattattttctgctgcttaaggattttttccatgggagctttgagaaatactggctcagatccgataagctggctgtcgggtcaaagggagccaataaagaattttctttttcctcagggataggaccatttctcagagtggaatgataaggaccctagtcactggagccacagaggttattcctggaactggaagctagatgctaagctctcacttgaaaataaggtttctctttcctctggaatggaggtctcaactggaagcaaagctggaagcaagaaaaacttggcttggaaaaggggtttagagttgcctgataaaatggttcacagcacccccatgggccttagagatttccttgtagcctggggtcaggagtcatccatttttgttctttgttctttttcagtttcaattctgatttcagaccatatttccttcccgccacgtcctcaatttctcactttgagacttcagtgcaggctgagagatattactcatctctttaagccctagagcctaaggaagtggaacatttatgtttctgatttctttatgttcacaaaggaagagacagtgctcagagagatcaccctccctccccccagcactgagcctgaattctctctttttttttttttgacatcactttaggtattactttgcccaacttctcctgagttactctggatctcagaactactttagtcaccatgatccttctctctctctctctcttttttttttttttgagacagagtttcactcttgttgcccaggctggagtgcaatggcgcgatctcggctcactgcaacctctgcttcctgggttcaagcgattctcctgcctcagtctcccaagtagctgggattacaggcatgtgccaccacacccagctaattttctatttttagtagagacggggtttcaccatgttggtcaggctggtcttgaactcctgacctcaggtgatccacctgtcttggcctcccaaagtgctggcattataggcatgagccaccacacctggctaatcctccttctcttatcacacccctactcccacccaatagtgaaacagacaacgtggtgcaaaaagaggctaacggtctcactcctgggatttctgggactggctgcatagtctgtgcctacctcacttcctttcagtcttggagtctcttagcctctacaattagtctgttagtacaggcaaagaccagttgctgcttgtctgagtccattttatgtttgttttgttttgtttttgtttgtttgtttgtttgtttgtttttgacagtgtcttgttctgtcacccatactggagtgcagtggtgcaatctcagctcactgcatcctccacctcccaggttcaagctattcttctgcctcagcctcccgagtagctgggactataggcacgcaccaccatgcccggctaatttttttgtatttttagtagagaccaggtttcaccatgttagtcaggatggtctcgatctcctgacctcatgatctgcccatctcagcctcccaaagtgctgggattataagcgtgagccaacacgcccagcccattttatgttcttataataaaatacctggagctagttactttatacagaaaagaggcttatttgtctcctaattgtagtggctgtaaagtccaagagcatggcaccagcacctgctcagcctctggtgagggcctttgtgctgtttcataatgtgacaaaaggtcaagtaattcacagggacaggggtccccatgactgaaacacctctcattacatactacctcttaatgattctacctcccagcactgccacaccggcaatgaagcatcaacatgagttttggtggggacaaaccacatccaaaccatagcactgctctactacttctgttccaagtctgttctccccccatgacctaatatcctggccctcatggtccatcttcttctcttcagcatcttcagtgggtcttctctctctctctctttttttttctctctctctcagctggattgtttcttggatcttgccttttcccaccaattgcatctggacacactattcttctgcaaccctgtggaaaatgattagaactgttaattgggccttgggccctgtttagatctaggatgatatacaaggtgctttaaaaaaatcttttctgttcacgcccacccactaccttcatcctctgcaaaaagccaatattacatttcaacataagcattcacatttctccatctgaaactttctggcagttccagctgcctattgacttagagtcagggaatcaactggccattgaattctggaagccttttgaactttcctcattacctcccacccccactgatcttttctaaacatgtttctaattatccacatcagcaagaggtagctgggaaatgggattgtttttattaaccatttgcaaaataaccttgtaatgtaattagtacaatgatagaacttaagagaaaaaagagatcattgaagccatactccccaatttggatagataaggaaggcgaggcccagagaggaaatatgctaccttgatatcatacagctagttggagacagacatgaacattttgctcaggtttcctgatacttgatccaagctatgaaggggaagggtgacctggtgagcaatgaaggtcgatgacttgggggacatggcttctccccaaagtggttgtcgcttgggtctagtgggaatgccaggaagcatatctcgatgcagaagtgatcaaagtttattacctggatgggaaatttgggccaaaggagagacaaggcaattaatcacttgagaagctcaggagtcgtaagctcatatgagtacttggcattaggacatagcatgctagagaagaaaaggtacaagctctatagtcagacacatcatggttctatatggctctgtaattttagatgcattacctctctaagccttagttcctcatctataatatgggtataattgctatctcacagggttgtttactgttcagcgcctgacacatgattggtgcttaataaatatgagctacttttttctttggggtctctgaagctctagattgtaaactctgggtgtgactgtggggcctgactttggatgcataatagaaactttgtggatacagtgttagtgtgtgtatgtgtgtctttgtgagtgagtgtgtgtgtgcatgtgtgtgtgtgtattttgaagggagatattaatttgttcataagggaaggacatcagcaaaactgggtccttgttccctgcttccatctccaggtatatttctatgattctttctcaccttacccttaccctccacttgcatccttctcccaaaaaacaaaataaaaaagactgcctaaggccagcctgacctcattaggatgtggctcagcttcactgctgccatcgacagtggtgggtatgctggggttgagctgagggccagactattaacatgctaatgtcagggactagagaacagagctcatctgtgttctcttggcaagcctccttttcctgcccactgttcagccaggaggctcaggacaacagggggcacctcagctgctacactgaggtacttaccctatttctaccctcatttccaccctaaacctgtgtaagaggaatcatgacttggctctgatcagggttggaaaaaatcctctcagaacccaggcacagcatggcttcagagtccttcacaatccccgttttatcttctcaaacattctttatttggggtattgtaaatggaactcagtcttaagggtgtgggtattacccccagttgctaaggatgaaggacaatatatgggagtggcccaagagaacaagatacaggagttaatccaacaatctccaccttcagcctttaatccatcatggaagtgggaagtggtgtgacattgtagagggaaggaggaggtggcagaaatcactggatatgcatggatttggagtcaaacagacctggtttgaaccctaattctgtcactcacaacctgaaacttgggcaagttatttcatttatttgaacctcatttttgatatctataaaatgggcctaattgtaagtctagcataggggtattatgaaaattaaaggagatgatggatgtaaggttcttggtatgtgtcagtgctcataagtaatagatccctttcctgcctcagcagtactttgtgcagagagatgccgacatcagttcttgattgctgctcaagtatattttcttgccagatgctgagcaccttaaaccctttaagggcagatataatattgacttcaaactttgtgtcctctgtgcctcacacagaggaagtattcaatcaatggttggttgttttggttttctcttctaggtggtgaaaactattggcttgagggaagtttggttctttggtctgcagtaccaggacactaaaggtttctccacctggctgaaactcaataagaaggtaactgcttattcctctgttggatttagaattcttttcttttccagaacattcctgggagggtaccatgtgctagttggcaaatcctggatacctagggctgtgtttgtgactgggtggtctgttgaccacttggatcagaataaggaccgaggacacaagcaaggcaaagctcttgctctgtctctactttgacttctaacagcgacaatggccagcattcaaagaagaagagactcttttctttctaatgggaacactagcttgaactttgacttgttttggatcaaatccattagtggcttttcaagagaggattggtatccccttcatctctccaaactcaatggctttaggggatttgtgttttttttgtttgtttgtttttgttttgttttgtttttgacggagtctcgcactctcgcccaggctggagtgcagtggtgccatctcggctcactgcaagctccgcctcctgggttcacgccattctcctgcttcagcctctcgagtagctgggattacaggtgcctgccaccacgcccggctaattttttgtatttttagtagagacggggtttcaccgttttagccaggatggtctcgatctcctgaccttgtgatccgcccgcctcggcctcccaaagtgctgggattacaggcatgagctactgagcttggctggggatttgttaaaaagagccacagattcttgaactagaaaaaaaaaaatctgaaagatcttacagtcttatgctgcaccttctccagcagtcaactaatgtctgaaccccatatagatgtttccctctttcttgatcttttacctcagttggaccccaaatgggatggtttgagtccatgcaagctctccaccccaagcagcatcttcacgggaacctggcagccttccatcttcgtatcctcaaactggctggccttgtccttagaagtctccatactgtcctgcagtttgcttctctgattgtgtctagggagtaggtaccccaccttctgctggtagagtcttgttttcctaaagagttgagtcttttgctggacaagtgtggagccactagtattccatttcaggctttaaaaaatggtctaatttgtgctcttgtttagccagttctcagtcctcagacatatatcctagtccttactttgctaatttatgaagttggaggagacttataagacgagcttaaaagaagagcttatgcctactatcagaatttggggatagttggatatagtcagataaaagtggtttgaagatttctgatcatcagtcggtattaaggtaatttcaggaagaaattcccaacagaaagtgattacagacatgggattcagtccccagtgaaagtaatgtattatttttcttaattaccaggggagttgccacccagctgtctaagattatgcaaattgatgatctttcagtgttttctccccaccctacagccactccattacccttaaaacctattttttgagagtccataacccttactcttcccaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagaggtgaggtggttccctgccctcctttgccttggccataaggggctgcagcccacagctgaccaatccctgcctcacagggatgccagatctgttcttctccattggggtctgtctgaagactgtgttatgctgctcaagagacatttgcatatagtgtcagactctgttgttgtttttctggctttccaaataaaaagcctttttgttttccctctgtctacctggttacagaactttattaccctggaggcaggtgcttatatagaaccagagattgagtaatttctttcacccatccctggttccattttctcagttctttttactgatttagatctcttatatcagaagttcacaggggagagagagaaataagcaaaccgaggacatggggagctcaaatagtcttttaatattgacagctagtgtacagagctttccccttttgtaaacttcaaagtcaaaagctctaaaacactcattatttttgtttttgtatcacaataacacacaaaatgaacaaagcaggcaatatccttatttcctggcgaaggaaatagaggtgcagaggtactcacactgactttccccatctggtgcagctcatctgaggcagagccagagccagacctggaagcttagcaccttaatattttaacactaagttttttcctactatacccaatggccatttccatagtcttttggattagaaggaaaagctttgcttcattctgggagcctcagtcccattggagttatggcatatatgtacaacacacccataagatattagggatagtgcttgtaccctggggactctacctgagtcattgccatgatatctgagatggcatgtttaaagcaaaccttgtttataatctagtaggtcttggaggttgggcctgttggtttttctgaaagccattaggactcagttcattgctctgtagccaaaggccatcctttcatttctgagcagtattcttataaacatagagtgttggtcctaagaggatctaggagagagtgtacctgactccatgaggtccatccctactgttagcccctaaagtcagcacaaactcctgacacattactgctatgcttagggaccacagcacatcatttgatttgtggatgaaggtacaaaggaaggtgttccccttgttgtttttgatcatccattcttgtagctctcttacctttcaggcaattccttgtgtctagtttaacaccttcttgctataatttcggtctgcttccagtgtgacctcaattggctgactctacatcctctttgcatcagccccttagaaagctaaatgggcttcccttctctcctgcacagggactttgtgctttaaactactcatcacccattgtctttccagagtcctggaacagcacaaactcaacaaggaccagtgggaggagcggatccaggtgtggcatgaggaacaccgtggcatgctcaggtaagcttgcccaagcagtggtgggccccacttcccttacagggtgaatgagaatgcgttctagggagaagagactgatgacaagggacattggtggatgttggagaaagagggaacagggacgatagaaggcaaactaggaccattataaggctgttttttgtttgcttgtttgtttgttttgctgaatgctggtaactggtagcccaaacagttttgactatcaagaaatggagggagctcttacacatggcaaagcatttttgagggttgtgtagttgaaggacaaatatcatcattttgccatcaccacattctgagccctgctaagaatgtgcctttataagaggctgtcacaatgaatgagagaaagaaaattgcttctatggcagccaacatgccagaggccagcaagggtcagcccatctttattccccttgggagcttagaccctaggtttttgttaggagattttgctttgcaaaagtcatgctgtgctctgttctccatcatctgcttgccttttgtcccctttcccactcctgatagcaagatccttgtcagaagtacagagtaagcaggctttctatctccttgggtctgactcacaagccccactttgtgacccccaactctgtgtcatttagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacaggtatatctcagatctcttttagtttatttaggtcacgttaacatctagggctcacttttcaccaaggagcagggccatatctcttgggtcccatctcagttctttttctacctaatttagtccagcccagatgatttcacaacttcccttagtcaatactaaatcctgtattgactagactcacactgtcaactatggtagccaccagccacatggggctattgaacacttgaaatgtggctactttgaattgagatgtgctgctgtaagtgtaaactacacactggactttgaagacttagtgtgaaaaacagaacgtaaaatgtcttaatattttaaaaaatatttatttacatgtttaaatgataatattttagatatattgggttaactaaacttactataattttattacatccatttctttttacttattttcatgtggctactagaaaacttaaaattatatatgtgacagtcattatgtttttattggatcgtgcaggcctagactatcttatcagcatttgtaattagtctcctgtgatggttaagtggcttttggcctataatcctctcactgtagccttatcccacttgcttatatttttcacttggtgtgctcttggtgaggatggagagcaataaattattgttccatataactcctgaatcttggagttcattatttactttctctcaaacttttgtaagcttggatagaagagactcagttaaatagggctggggattcccttgaggaactgttacaagttccatgcctcaaacaaatacataacaaaacaaacttgagacaaggaatcatatgttagttgtactatcaggagatctttagtgaactctcaatgctggcagctgacctggtggcgtgtgatgacactggctgagctgtcactgagtctacctcctccagagagaagtgtttgtttggccaggctcagtggctcacgcctgtaatcccagcactttgggaggctgaggagggaagattgctcaagcccaagagttcaagaccaacctgggtaacatagtgagacctcgtctctatttattttaaaaaaaaaaaaagagagagagagacatagaagcttggaggtgacagtgagggcaagcccccagttctctacacccttcttgtcttgcccttgtcctgatgttattggtttctatttctacagactaactcccaagataggcttcccctggagtgaaatcaggaacatctctttcaatgataagaaatttgtcatcaagcccattgacaaaaaagccccggtgagtgattcctccctctgaccaagacaggtacttgccaaggcctgcataatgagcaatcatgctattctatttttctcttccttttctgatgtgtttgtgtgtacgtgtgtgcgcgcatgtgcacgaacaggaagcacaaatagagattgggaatggagggggatgttgatgccaagaaatggccagcagacatcctgtacctggttctactctgctacctgtctctctcactgtggatgtgggagagccacaggcagtgttaagaactgcttcttagccattgcctctgctgccctgaggttctggggtggaaaccgaatgcatctcatatttccaagcccctgggtcccagaaagtggacactgttcacatatttgattccttccttccttcctctctctctctctctctttcttttttttgatggagtctcgctctgttgcccaggctggagtgcagtggtgcaatcttggctcactacaacctcagcctcccgagtagctgggattacaggcgcatgccaccatgcctggctaatttttgtagttttagtagagacagggcttcaacatgttggccgggctggtcttgaactcctgacctcaggtgatttgcctgccttggcctcccaaagtgctgggattataggcgtgagccaccatgcccagcccttgacttcttttttttttattgtggagaaagggctgtggccaaagtccaaatctgaagatgatcctacagacttcttggtagaactttactgctgccctctcagacttttctccagagcaatccaagaccaaaaaagtgctttaagttcattcatttctctaacacactcgccatgcttcttacccactcagtagcctgcagctgacaagaccagacagctggtgattgtgggtaggttaggaaactgagctgagtgtccccttttctgggatactgcatgtccaacaaggcccagtgacaatgctgagcctgacccttttcatgaaggctcagtgattcttctccagccatgaggtgcctgaacttcccctgctagggactttacacatgttgtctccttaaaccctcagcaacatggtcaggtaggtactaagtagcatactaattttatggctgacaaaactgaggttagagagatggagtgatttgcccaagatcacacagctaaaaatggtagagctgggatttatacctgcaccccaagctatatgagacagtagcagtgtgtggtcagtggcagaggagatggtggtgcccatcagctggtgacttcggtccagtggtatttgtagtaacaaactcaaactcactggattttcttgtgtgttttcttttattgctgctgtgctcaactattatcagaaaaagttaagtaacaaagccagctgagatcaagggctcattttaaaaacaacaaccaggacaagcagtgatcaggagatttatgtattcatgtatgtatttacagcctgccttgttccaaaaaggatttaaggggctgggtctaggatttgcttttaggagattgtagaaacagtccagccacccatactgcacccaccagggtattattcaggggtcatttggcttccaaaagaggtcacctgagacctagcatgttccctaattagcagagaaagtttgaatccttcaacttgattaagagtaatttaggatgctttcacaagcaaagattgaaagaaattgtggtttcataagcaaagattgaaagaaattatgggaagaacatgggtttcagagtcaagaaacctgggtttctagtcttgggtctgtctactgtctaaccctgggcaagtcactttaccactctgataattagtcttcccatctgtagtgcaggaggtcagattaaatattctttccagtgcttttggatttagcttttcagaaggcagaagatcaccttcacctgtccctccaaattctttctgattgctgatttcccaccaggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcggtaggtgctgcacactgatgtggggggccagggctggggcaaggaagcttctcaaaggtgccctgcatgctaagtcaggacatgaggccaacctaggacttcatagatgagaggttagacaccaatattcacatttattcagaaaaaatctaccaagtttgaggggcagtttttacagagctggatctagcaggaaactgccctgtaggacctcacagtctactcagtctagtagcagagagagggaaaacaatatatacataactcaaggtacaaaggccatgtcattcattcacttaataaatatttattgagcaatgaataagaaaagaccaaaaatctctgcttttgtgaagctagcattctagtggggaggagacgaacataataaataagcaaattatgtggtacataagatggttaagaagtgctatggagacaaaaacatagaagagggatggggagaagggtaagccaagtattctgagggcccagatggagaatacctagccaagggagataagaaggttcctggaagaggtgctagggcaagaaaaagcaaaagcaaatacttattccagatttgtaacagactctgggaaaaagaagcctagagctgggctttagggcaggcagtgttagacctgaggactgatgcactagccgtagagattactagacttgaagcacttcatcccagcacagagccaaaacttgtctccctaacaaggtggatagggcaggtcttattggaccattttcaagataggggaacaagagcaaagcagtgacatagctaaggtcacccagtgggttggtgggagagctaggattcctgactcaggggtacattgacagggccccgtgtacactggcctatgtggggctatgatatgaggacaagggtatagaggtaagggagggtggcccaaactcacaatccctaagtgtgttgggaaggttgggttgagagacccagaggcagcaagccttggaattccccaggcttttttttttttttttagatggagtcttgctcttttgcccacgctggagtgcagtggcgcaatctcagctcactgcaacctccgcctcctgtcttcaagcaattctcctgcctcagcctcctgagtagctaggactacaggcgcatgccactatgcccagccaattttttttgtatttttagtagagacggggtttcactgtgttagccaggatggtctcgatctcctgacctcgtgatctgcccacctcggcctcccaaagtgctgggattacaggtgtgagccaccgcgcctggcctccccaggcttttgtggagcgttgttatcctgttctatccattttatctccttccctagtgctatgctggaaaatgagaagaagaagcgtgaaatggcagagaaggagaaagagaagattgaacgggagaaggaggagctgatggagaggctgaagcagatcgaggaacagactaagaaggctcagcaaggtgaggcttggagtcaccttggagattggatttttccaggcctaactctgagctggagaaccttctgcctgagctgtagactcagacaatgtagttcaggtgtggctacagactagaagaagaatgggcaagaagagagctcagaactttctgccagctttgtcttggggtggatcatttccaggaacgaagctattgtgtcgtctttatctctgtgctcttcactgccttctcccctccttttctgctcagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggtaaagctgtagggtgggctgggattatgggaactgaactttcttccttgtctgcctacttacttatagctacttttgcttacatgctggctttttagagcaggctaccactccatgggcctccagcaaataactagttcagaagcaagctgagaagtcactagtgtggcccagaaatttttgcagtcttccctaacccttagtttctgttcactttcttaactcttgggtatctgagctgattgacctggcaaaggaaagggaaggagaaaagaacaaaagggactcatatttgagctcctgctgtatgttgctgtgttgggaatatttcccttttccttacttatttcttcttcccagtaaccctatgggattaacctcatatgagataatatcccagataaggaaattagagctcagggaagagattcaccaaagatcacacaattgtagctaaataaggattagaacccacccatttctgcctctgtttgaaagctttgctccctgaaatcacatgcaaaactatgtgtctatgcatttttggggcatttggcatccatactttcatcacagtttccaagggttctgtgactcagaagttaagaacctgtggtccaaactccttgacatatactcttcctttgtactgttggaggtgggaatagagggaaccaagacctgtctctcatgaggaagctgtcatgggagatttacccaaggtgtgcataagcttttttccttgttcagatagctttgtgacacttgagtgtctttcctgtacttgtcctgggaagactcttagtcgaatcctgagcattctaggatatcaggaaaggatctgccacttcaggaagtgacccaatgatggccaaagctttactgaggcccccagctgcatacttgccaagaggggcagggggagagataatgaggaagggacagagatggcatattgtttgtcttcaagaggcctacagtctaggtgggggagctctgacttaaaaggaagtggtggtcagggaagatgggactggaatgaagtagtctggtaaaagagtctctgaggcagcaagcaagtggagcagtaggtcccttactagtcccccaggggacttgggttgaagacacctgggtcctgaggaccagaaggcccagctctcacaggcttccaatttatccgtaggccttggaaatggcagagctgacagctcgaatctcccagctggagatggcccgacagaagaaggagagtgaggctgtggagtggcagcagaaggtaagacacagggcctaaagcaaagcattgaaggaatgggtgccatatgcataggtaacagctccttagattccttatgttttggctccctccctctttcatacttcccacagcaggcagcatgggagaaggcactcatggtttcgtcaaatacttactggagttctctaatacctctaggaagttggtacaattgctcttgttttatggatgaagaaactaaggatcaggcagatgaagtgccttgtcctacctggtgcctgcctcttgccagaccgttctaggcatatacaggatgccacagtttaactggtctcactgacagtctttctctccttctgtcactggacaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggtatacaagtagggccaaggggcaaggaaactatatgcattgatttagtagcccatggcattccctagaccatcatgggggataggtataagatcctgtcccagtgttgtatgggagcccaagccgttcttaagtgacagctttaaggataggcacctctcacttattaatcagaccttgggctatctcttccctttttgagattttctctctgccccacctcccactcactccattcacctcttacattaagaaaatatctagctgacaaaattcccacctgaatcttttgtatgttgttctactcttaaaggatacccattatcaactggtcccctaagtttatttatttttttttaatattcttgccccactgcagttctaacagagttggaaatgactctcaatatttatatatagagagaaagggtgaggaagaaagaaggaaacagaagagaagggaagtctggtcaaataacaggaggtaaaatgagagaaagccattgacctctgtgttcccatacatcctcacaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctaccactgtcttcttcagggtcctgagatttacacggttggagtgttatgcggtctagggaatgagacaggacctaggatatcttctccaggatgtcaactgacctaaaatttgccctcccatcccgtttagagttatttaggctttgtaacgattgggggataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctccaaagaggtgactgggccctgcctctgtttgacaaacctctaacccaggtcttgacaccagctgttctgtcccttggagctgtaaaccagagagctgctggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtcctcaaggggccatcctgtcccaccatgcagtgcccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggttttttaaaaattgtttttggaggggtttatgctcaatccatgttctatttcagtgccaataaaatttaggaagacttca

SEQ ID NO: 108 - DNA, 2157 bp, Homo sapiens
tgttgtttatttatttatttacttatttctttccacacgctctgaaggacaccgtgttaaaaggacacagtgttaaatgttatttttaacactgaggctggaaggccacatcactgtccctcacaaatacttcaaacagttgtcttcaagatcttacggttctttgcctgactttttttttttttttttttttttgataccgcgaagaacagttgggatgaaagggatccatccattgcttcctttaagatggcctctaggcagtgggttttctgtaagtctggcacaaattctggagccaatctctggcaaggcagagtgctaggcgaggtctagggacccagggtctgcgcttgaagcctcccgctcactggaaattattgacttccagagatacatacattttttttaatttaaaggggaggtgcacagcacaccttcctccactgggagaaagggggcccaattcccactcccccaaacacacacaagtacacactgactaaggcacagctagggcgggggcgggcagaaggccccttgggaggacgtggcgccacagctgcaatgggtgtgggggtgtggagctcatcaccgctggaggtgcttgggggcaggagaagaaaagcctcagggctccccaggaaataggagaagatggtcgggaaataggcagataagaaaaccaacaggaaacctagaaaagaattgagaggaaagaaacaaaagagagagtggaaaaagagaaacgggtgaaaacaggttgtgggcaacagaacaaaacaagaaggaaacagcagaggaaagggaagaacatacatcagagaactgggaaagtgcgatgaattgggaaggaaagaaaaggggaggaggggagatagggaagaggaaaacccaggaaatgaatactcaataaagaaaactcagcgggggcaggatgaagaggttggagaggcaaacggggccctttgggagtcttagaccttgacaaaaaccaggtgggcagagtacaccaggtcgcccacataggccagcaagttgacggccgtcaggttggtcacagccagtcggcggtcccagatacacacaaggtaggggtttctgtcgctgcagctcacatctctcgtctgccagggctggacaccatacttctcgttgaactggtagaggggccagaggacaagggcagtggcatagaggaggacggacagcaaggccagccccaacaggaaactggggaagcggatgggcagcatgttggtgcagtgccccaggctcagcaggatagtgagggccgccaggacgaagcagagggcgtacaccgccacccaccactccagggccggccggttgtggtacacgtaggggctattgatgaacacgaagatgaggcaggccacgaaggtctccagcaccttcagcagccccagctcggaggccatgtagtcagtgatctcgccgggccgggcccgggtccaggttacttcggtggcgtaagccacacaggcgatgccagagaagacgatggcggcgatggcgtggtcgcgggaacggccgtgggacaggaactgcaagtaggtggtggggtagatgatggaggccgagaggcacaagagggccgcatagcaggcaaaggtgatggggaagttgcgccaaaacaaggggaagcgggcctgggagccgcccagctccacgaggaggatgaccagggtcatggcaaagcagaaacactaggtgaacatggaccagttacccataggccccttccaggcgcccacgctggccaccagtgacaaggccacgcaggtggacaccagctgcagcaggcggaggaggcccaggggctggatcagggccctagaggaccctacgacggtgggggaccgcatggtggtcgtgacggttgggtgggtaacagtcaccggcatggcagcagtcctggctgaggaactcacggagaaaaggtctggctgtggaaacggattaagtcacacgcctggaaaaggctgggaacagcgagagacaatgtcagtgtccactgggtctgggcttctccctcccaggacccgccaccccgtggaacaggaacatagcaccgagcagggaagagacctggccttgacccggagaagtcccgcccctctccttccaccagtt

SEQ ID NO: 109 - DNA, 7003 bp, Homo sapiens
ttatggaaaaaaaaaaactgtttatgcacatcactggcattgccacaagctgaaaaagaaggcagagtgggttgggagtagggaagaatggcggagaagggtggggggttgtatctctaaatctgtgttgtggggccacatagggtggacaggggctgtgagttacagcctttaggtgctaccctcagcctgggcttccctccaggcctggcgcaccttgatcttcactttgaaagagtcgatcagaaagaccaccttggggatgccttccagggagggcagctgcccatcatctggcacctccaggtcgaacctctgcagcagccaggccatgatgaggaagagctcctggcgggccaggatctcacctatacaggagcgaggtcctgctccgaagggcaaatagcttactgacggtgagatgagctgggtccccgctggattcaagaaacgctctgcaggcaaggagtggcatcagccaggggttagggcaggagggaggagaggcatggttctgccctggttgagggggagacatggccctgcccagggaaccctgatctgaggatgtagccttattatgggggaacccccgcctggggagagatacagccctgctttcaggtagcccttaacgacacagaggaaatgaaatattcaggaaggatggaaaagagatggaattaacctatgaaaatagcaccatccgaggggagaagggacagacttaatggcagacagaggcgtagagggcttcttggagggtgaatttgcagttggttggaagaagagcgtgggaaacccagctgtgaagagtttgggtaagtctatggcaggatgagggtgtcaacaggtccgtatagttggagccaagagttttctagcagcaagcttggcagaggtgaaggggtactggggtggtggagcagagtccaggctcgctgtgtggcccagggcgcaggacaggacagactcaccaggcatgaactgatccggctggtgccactccttctcattgtgatgcagcgcccacagattgatgataacttctgtgcccttgtccacagcaaactcaccgatgctgctccagagtggaagaggaaaagtgggtctgggacttcgtactcccttccttgctcagcctcatgccccctcattcttccgccgtgaggaaaatgccctttactccctcattcccactcactcatgttttcctcagcttctgccagatcaaacctaaatccagcccttctccatcccttccctcctaacaggcgcttctgtctgaacacctgtgtctgtggactttggtgtctggcagtgtatgtgggtgtgcgtttggagctgcagcgcatgttatgtgcgtgctgcagctggttggaacatggagctcccagcctttcatcccagaccacatgtctctgagggcagcaggaagctcctctgggaagtcaggcagatctgtggatgagtcaatgcgtgtctgtaggtggtagagacatggagccacggggctgggggcaggatgatttttatatttaattaattaattatttattttgagacagagtcccgctctgtcacccaggctggagtgcagtggtgcaatcttggctcactgcaacctccgccgccttggttcaagtgattctcctgcctcagcctcctgagtagctgggactacaggcacgcgccacgatgcatggctaatttttgtatttttagtagagacggggtttcaccatattggtcaggctggtcttgaacccctgacctcatgatccacccgcctcgacctcccaaagtgttgggatgacaggtgtgagccaccgtgcccggccggcaggatgatttttagtagttgatggttgactgactttaggttggccagcaggggccgggggtagggggagccaggtgggctggcaagcagtgttgaatgcatcatggggctagatgtcactgggagggcaggcacacctggagtcaacgttggccttgtgggggatgagcataggggccacgggcctgaggcgaagcacctctcggatggtggcctccagcaggaggagacggttacggtcactgatagttggtgtgcggctgaaacccacattctggtcaatctcctcgtagagcttcttcttcacctgaagaccagagtaggttggaggtgactagtgtgtgtaagcccaggagaagcaagggcttagagaagaatccaactgtgacatcgagaagagcctgtccagtcccttcccagtagtggctctggggcccaggcccggcttccagaagatggggcagctctactctggggtcaaagccaactactgcttgggtaaggagcagggcaggcctagtcttcctgcacagaaagcctgagagaattggctctccctttctctggagcccagagattgggctggctggggtctaggatcaatgagggggaagcacacctgaggattgtgcagcaggaaggccagggtccatttaaccacagaggtggtggtctccacgccagccccaaagatgtcccctatggtggtgagaatgtggttatctgaaagcagctctgagtcttgatctgggccagcattgccattatctgagttcatcttggcttgcatcagtgtgtccagcatgttggtgatagagtcactccggaatttctcctgggttgggtgaggttgggagacattaataaggaaggagccccatctgtgacactcctgccatacttctgtccctgactagagataacaaggctccttccacttggaagtagagcaagtctgggcaggacctacgaacttgtggaggtaggaggcagccccgggccctctttaaatttggtggagaggttaggtctcttctaggatcctcttcagttcctcacttttcgatcccaactccttgagtcagttttttttttttttttgagacagaatcttggtgcaatgcccaggctggagtgcaatggcatgatctcagctcactgcaacctctgcttctcgggttcaagtgagtctcctgcctcagcctcccaaatagctgggattataggcatgcgccaccgtgcccggctaattttgtatttttagtagagacagagtttctccatgttggtcaggctggtctcgaactcccaacctcaggtgatctgcccaccttggcctcccaaaatgttgggattacaggtgtgagccatcttgcctggcctagtttttgtatttttagtacagacggggtttcaccatattggccaggctcatctcgaactcctgacctcaattgatctgcccacctcggcctcccaaagtgttgggattacaggcgtgagccaccgcgcccagcccttaagtcagtttttattgtacacctactatgtgccaggttctctgcttggttttgaagcttctacagtgtgtagaatggactccaccctgctcttgtgattacttttagcctaactcatattctcttctgctctatcacctaccttgtaattttcaagtattttattcagcagatcatttcgtattttaacatggctctttaatttttccagggttttgttggggaaaatctgggaaataaaaagaaatgttaaatccacccttcttccattttgcttctccagctgccagagtctctcctggaggcggatcttagctttctgtctctggaagttcctactccacccctgaccttcagccagaatggaaggcaagatggggacacagaacgggtttatcatgacgacgaagacaattctaaacaagggaggagggcgtggtctccacctctccttccccattcaatcaaacatcaagcgctgactctgctatgtgtccagcccttaggagtgagagagacatgagcctgaaggctcagacaagctccttaaccccgctaagcctgcttctcacctgcacaatggggataataaaacctacttccaaggggaattcagcgatgaatgcgtatagaatgcttagtactggcacatggtaattggaaaagaaatgaaggtcattatctggagtactaaggtgcataattaaaaggctaaatctatctctgcagagaaatggcaaaggttttaagtggcagaggaggtagaggtggcggaggtaatcaggaaaaagatgggtcattgcggctggagcagggaagtaaaaaggaaggaagattggggacaatgtcagggtctactagaacctgaaggcagggctggcagcatctcaccttcaaccaggggactaggtccaccaggctgtctttgctcaggttgtctatgatgccttcattgtaattctgtatgacattcaactcagggtccccattcttgtaggaggtattgaagcagatcaaggagatgacattggttaccgccacgaagacaggaaaggagatgtctatggactgtccgttgtgggtggccagcatatcacacaatgtactgatttcctgacaaactgaagggagagggggcatgagggtgggaaatgaatcagcacccttaccccctctctgtaccagttgcctcttaacaggagcgggggacagatagcagatggccactagatggcagcagtagccaagaaaaggctgcattgcgctctagtcctaacccttacccctgcccaaccctcctctccctccagcagctcctgtgggatccagccccagccccaggggccagcctggcactcactgatcttctccagcttctgatcgccatccttgaacagggcaaaggtggccatcgccagccttcgatgcagctgccagtgtgcgccagagtcagcgaaggcgatacccttacggttgttggacgcgatgtctagagttgcctttagagagcaggcaaggctgtaggaatctcacaccatccaccccactcttgcccttacacctctggtccctgctttccttcctggaggagaaggcaggtacctggcatgctgactcccatgtgggcacagccccactgcactccaccatgactgcaaggacttggtaggacagaccctaaggcctcctactcccaattccttcagaaatacagtagatcaaggagaaagaaagaacccttaattagaatgcagcagcattggggttcttttcgctgacagggtgccctctgggcttctttttgctcatcagtttctgaccacaggaaggcaactctggatgggataaactctctaaactatgcctgtccagagggtagggagcaggtgagcttgtagaggctgaggactgcacagatctctgcttttccctgagcccttagctgagctaaaggcacagctcacctcactcaggtttacccttccattgcaagcctgcatacccagccacaagcccacatttggagagtgcagatgttttgtctacccagtctggacttgggccgagccgcctcctcctagaggtgccccccaaagcaaaagggtccaaagcctcccttttccatttcctgaccctgaagatccacatgactagccttctccatcttctctgcccccgggaggaagccagcagaggtgggagctaggtagttggtcagcagacctggctgattggtccaagaaaaaataaaccaacccttggcttgatcaaagctgagaggctggcagggcacagtggcttacgcctataatcctagcactttgggaggctaaggtgggaggatcacgaggtcaggagatcgagaccatcctggctaacatggtgaaacaccatctctactaaaaatacaaaaaattagcgggcatggtggcatgctcctgtagtcccaggtactcaggaggctgaggcaggagaatcacttgaacccgggaggcagaggttgcagtgagctgagattggccactgcactccaggctgggcgacagagagagactctgtctcaaaaaaaaaaaaaaaaaaaaaaaatgctgagaggctgggggccctgctgagtgggaggctcatcagcaaccctgaaatgtcattgtagaaaactgcccctgtgagcctgagtagctggaaatagcaccaggaaagcagcaatcccagcctgcaatagctaggctaattctccccagcagctttcatggaggacagtagtcactgcccccattttccatgaaaagtaacatgaatcctggctgtataaggggcacttactgtgctgggtgctaggctaagtgctgtacatgcaccttctcagtccattagagaagtctaggctcagagagaggagtggagtgaggattccttgacccctcagaccactgtggtcctcccatcccacctcctgggcagcctggtagaggagacattcctttaattcttcctgcctaatttagaggctgggtgggggtctgaaggttcactcccttcacatcatcccactagtctactttgggaagaattacaggttgttggagctggaagccccattctaggcatggtctgaagacctgaacaatcccagggggtggtgaagggggcagggaggagatgggcaccacttaccatttgaggccgcccagagaagtccttgcccttcttaataagcacctccttggccagctggtggtggccgacaatcactgtagtcttggtgcccatacgaaccgaatagatggggccatattttttctgcagcttgaagaagttgttatgcatatggccgtgtctggggaggaatggcaggctgcccaccaggggcagggacaggaggctcttggggtacttggcaccagggcaccttctcttgggccaaaacaaataagctagggtaagcagcaagagagccacgagctcccacatggtggctgggtgccggcaggcaagatagacagcagtggagtagaagagctgtggcaactctagggcacaaggaggccttttaaagggctaccctgatcttcaccttgactttgtgttatctcttgccttgtggaaagattctcctggagcccagccaggcctgagctcatat

SEQ ID NO: 110 - DNA, 10752 bp, Homo sapiens
ctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgaggtgagctggaagtggactctcccggcctgatagtccggggagtcgcagtctttcgttgctgtgggaaggaggtcgcgttgcatcttgggaattgtaggctgtgaagtacttgctatgagtaggtcttcttcgcggaggcgcgtgttgcattctggggtgtgcagtctctttggttagggacagtgtgtgagggttgggggaagaagcgatgccatgggaacctgtgctttaaaacagctctttgggaggccgaggcgggcggatcacctgaggtcgggagttcgaaactagcctgacaatcatggagaaacccccgtctctactaaaaaataataattaaaaaaatatatagccgagcgtggtggcacatgcctgtaatcccagttacttgggaggctgaggcaggagaattgcttgaacctgggaggcgaattatatatataagtattatatattacgtattatataatatatatacgtatatattatatataatgtgtatgtatatattacatatataatatacatatatattatatataatatatgtaatatatattatatatattttcaactagaggtgtttatagttaaccacctgtaaatattcaacatattcatcataataaacgtacatttatttagcattttatatatgctagacactgttgtcttttatggagtttaattcatgaagtctttagaatgactaattgaaggaagtacttttccttttttttttttttttttgagacggagtctagctctgtcgccaggctggagtgtagtggtgtgatcttggctcactgcaacttccgcctcctgggttcaagtgattctcccgcctcagcctcctgagtagctgggattacaggcacgcaccaccacacctggctatttttgtattcttagtagagatgaggtttcaccatgttggccaggctggtctcgaactcttgacctcatgatctgcctgcatcagccttccaaagtgctgggattacaggcgtgagccaccgctcctggcagcattgcttcttgagcagtctccacatagctattttgtttgattagctgagaatttcatgtgtaaaaaactcattccacagtattcatttaacaaatacttattgggtgtctgctatgtgccaggaactgctctaggtacacggaataaacaaaactaaatccctctacttgggaagtttacattttagtgaagagacagacgataaacaagtgaaacagaaaaaaatcaggtggtggtaaatcctgtgaagcaaaattaatctgggaatagagagtgatgaaagggttaatctttgtttgtttgtttgttttgagacagaggaggagtcccactagctctgtcacccaggctaaagtgcagtggcccgatctcgggctcactgcaacctctgcctcctgggttcaagcgattctcctgcctcagcctcctgagtagctgggattataggcgcctgccaccacacccagctaatttttgtgtttttagtagagatggggtttcaccatgttggccaggctggtctcaaactcctgacctcaagtgatccttcccgctttggccccctaaagtgctgggattacaggcatgagccaccacacccggtcgaaagggttaatcttaaacagatgatcagggaaggggtctctggggagagagcctgtgaggagaaacacactgacatttgcccacagcataatgagtggttatgactcataggcttgtctcttgcatgcctgcgcttctcctcctccatttgagttgtgtgcttagtgagggtccattgtgtttttttctaaacatcatgtgtctgtgggctgggcgcagtggctcatgcctgtaatcctaacactttgggaggccgaggcaggattgcttaagcccaggggttcgagaccagcctgggccacatagtgatatcttgtctctgtaaaaaaaggaaaaaaaaaaagaatgaaaacaattttttaaatgtgtgtatggcacttatgcttacagttgcaactacgtaatttaatgaaataatacgaaaaatgaaatatgagtaccaaaaaagagggttgctattgctatgaaaactaagttgaaaatcagaaacacttgttgaagatgagtagctaagacaaattgttattgagttaattatgaacaagttaatggtaaaagcctaggagaaaaatttatagaaatctaaaaagattctgtagtgaagattgttttacaggtgtattcaagatgttcttccattttaaagaaagcaaaactagaaatctcagatggtatgttatgtgtctggtctgtttatgtaggaaagtgatgcagaatgccaatgaatatatcaaggaaaagccttggctttacattacaacagcccctgccttcaaggcaaccacaactcccattgagtctgttttctaaatgtctcacaaatcctttgtttctttttttcttggctacttctgtgtttcaggccatcctcattccttgcttagagtactgctgtgtcatcctaaccaatctctctgcctcattccccactctagtccacctgcttaccacatttctaaaacagaaaaatggatcatgccatttttctctagaattacacacaaagatgaattctaaaccctaacttttaagtctcagattagaagtcacttcttttagggacctttcctgaacacctacccctgtaatcagttagacactcctgccccactacatgctcccggagcagccaatgcttccccatcagcacttaccataaggtgatgtaagtgcctatgttccctttgtaacccctccagattctgagccccgttatcactcttaaccagagtaagggcatatgttaaacactcaacaaatgtttattaaatgagtaagtgaatgaagtagattgttggaacccttttttttctgccatcggtttgtaagtcaccatctcccatctataggagtttgaagtttacccttaaaagtagccacaggaggaacaggtactctcataattgttggtgggaatgcaaagtggtacagccctaaaggagaggaatttggcaatatgtagcaaaattaaaaccccacagtcacaaatcacagtcctgtgagtccatcccaaacatatgctggcaaaaagatgcaaagataggagatatttgtaacagtaaaagctatgagataagatccaagatttgagaattttttgtaccactacttaccgtggcaaaagactgggaacagcctccaaatccgtcagcagagaactgactgaataatgttatggtcacctgtagagtgtggtactctgcagttgtaaaagagcaatggattcattaggagatagcaattgaataggagattcaatatgtattgctgcagataaccctcagggatctattgcaaagtgaaaacagcaaggtgtaggctgggcacggtggctcatgcttataatcccagcactttgggaggctgaggcaggcaaatcacttgagcccaggagtttgaaaccagcttgggcaacatggcaaaaccccatctctacaaaaaaatacaaaaaactatctgcgcatggtggcatgcacttgtagtcccagctactctggaggctaaggtggaaggatcacctgagtccgggaggttgaggcttcagtgaacagtgatggtgccactgcgctccagcctgggtgacagagtgagaccatgtctcaaaaaaaaaaaaatatatatatatatagagagagagagcgagcgagagagagagagagagagagcaaggtgtaaacaagtacacatagtatgttacattttaagtaggaaagtggtatggaggaaaataaatacatgtgtccattgtttaaaaaggaacaatggaaagaaaaccacaaagctaataaaaatagttatgcatggggctgggtgtaggggctcatgcctgtaatcccagtactttgggaggctgaggcgggtggatcacctgaggatgggagtttgagaccagcctggccaacacagtgaaacctcgtctctactaaaaatataaaaattaggtgagcgtggtggcatgtacctataatcccagctactcaggaggctgctgcaggagaatctcttgaatccaggatgcggaggttgcagtgagccaagatcgcatcactgcactccagcctgggtgacagagtgataccctgtttcaaaaaaatgaaaattaaaaaataaaaaaatagttttgcatatgggggagagaacagggaaagaaagggacagagatggaaaatcctattttattgttttgactttagacatccagaaggggttactaactttaaaactttaaataaagttgccctgtgttggggaagaaatctggcaatcctagttactttgaagtcacgctacccttttcactagagtctccctgacccaagagaacagggaagggccggtaggatacacataacagtagctccttttacttggctgaatttaggtatgccaggagcagggtgcagtattaggccagaaatctctgttggtctctgcttgcctctcagtgctaatgtggtcagctctccttgactgtagaccatccagccaaatccaagctctgcttttctcttttggactcaggacccattaaactcagtaacctcattaaattctgcctgcacatttctcctttcttttcttttcttttttttttttttgagacagagtctcactctgttgccaggctggagtgcaatggtgcgatctcggctcactgcaacctctgcctcccaagttcaagagattctcctgcctcagcctcctgaataactgggattacaggcacgtgccaccacgcctggctaatttttgtaattttggtagaggggttttgccatgttggccaggctggtcttgaactcctgatctcaggtgattgcctgcctcggcctccgaaagtgctgggattacaggtgtgagccaccgcacctggccatctcctttcttttctttttcccagccctgtctggtcatcttttatggggtggttccccattttaagccctgagcttctcctcatggcttccccacaccccccactgtttctcttattccattttttttttctttttttttttttgagacagggtcttgctttgtcgcccaggctggagtacagtggtgagatcttggctcactgcaactttcgcctcctgggttcaagcaattctcccacctcagcctcccaagtagctgggattacaagcgcagccaccatgcccagctaacttgtatttttcggtagagatgcggtttcaccatgttgcccaggctggtcttaaactcctgacctcaagtgatccacccaccttggcctcccgaagtgctgagattacgggcatgagccaccgcacctggccttctcttatttcatttctaaatagctgtattcctctgtccttttcagccccattctaactcttgcatctttactactttcaaacaaccccaaatctcaaatctgcctttaaagaattacgagtcatgttctctcactggacttgtggagccaaagtttttttgcagacttctcttagcacttaatgaatacactgtgccaacagcccagcagttaggaagcacttgatttctcaggcagtggcctttgaaacagatgtcgggtccatgccagaactgccatagtgccaatgaaatgaattttcaacatgaacaaatagaaaattatccttcattacattttgagtgtttgtggttgtatagggtggaggagtgggagaggagagagggtagtagtgtaacagctgcagagagaagattacaggaagtttgggaattttgattattaccattttatttttgtcttccagctgctaggtcaggcagctcgaaacatggtactccaggaagatgccatcttgcactcagaagatgtaagaaacaacttttttttttaatgatttgggtttatgtatatggtttgtgtggccacagggaagtggaaatgttctatttctctctctcttttttatgcagagtttaaggaagatggcaataataacaacacatcttcaataccagtgagtatgccccctccagcaactatttgctgcagaatcattatccctggtctgctttcatggactttgtgcttcagcactttcctgtggaggccagagtgggagtaaaggtgggggtggccaaggatgactttctcgatggcaaagatgcctgagactacagaagaagtgggggtaaaggatgagaatcaggagcagagtccaccctttatgaacctccccatgttaaattgagggctcctcagagagagactataaaccctgtaaaggcagggcccgtgccaggaccatgctagcactgtacttggcacctgtgaggccgttgatcagtatttgatgactgactgtgcccaaggtctcttctgggaagttaagttgggtcctctactagggaatgaagtataacatacctgtatcctacatggtacataggtaagtgtggcacctgctacatataaatcatgtagggaattttgaaatataagaccccctctttctccattataatttgctcttcatcttatttcatgttgttttatattttatgtacttgatattatacttatgtacctcttagaaatatatggttggggctgggcatggtggctcacacctgtaatcccagcactttgggaggccgaggagggcggatcacctgagatcaggggttcaagaccagcctggccaacatggtgaaaccccgtctctactaaagatacaaaaaagtagccgggtgtggtggtgggtgcctgtaatcccagatactcagaaggctgaagcatgagaattgcttgaacctgggaggtggagtttgcagtgagtggagattgcacctctgcactctagccagggtgacaaaagtgaaactctgcctccagaaaaaaaaaaaaagaggctgggcacagtggctcatgcctgtaattccagcactttgggaggctgaggcaggtggatcacctgaggtcaggagttctagattagcctggccaacacggcaaaaccccgtctctactaaaaatacaaaaattagccgggtgtggtggcacacacctgtaatcccagctactcgggaggctgaggcaggagaactgcttgagcccgggagacggaaatggcagtgagctgagatcgggcaccactccactgcatcctggcgacagagtgagactctgtctcaaaaaaaaaacaaaaaaacaaaaacaaaagcaaacaaacaaaatatatatatatggttaggaatttcactcttcgatatttaaatagctaatgtttgtcataatcattagtcattctttgggtatctacatattaggtattaggtatgtgaccatttgattccatatacacagactaattttaagccatgcatgtagtctgttgaaccacatttctcactctgggagaatgttactatctgtttgggtttagattccatcttttcagcagctctgcactcagacaggaatccctgttcaatagcacaatcttaggataggatggacagaaatacaggatgtgacataagctgaaatttcttctgcctatatgtattatctggtcataaatgaaacttattagttcacttatgtgtattttcctctttccttttctgatttaggcaagaagctattcagaagaagtaagtaaccccaaaggtagaggagtagggaaccaactgaagcaggctggggggatttatactgctgggtccagaatcaatacaaaaccctggttgacacctgccctcaaattgaaatatgctctgggatactcacttgggatttaaagatacagcatatttcaaaggtgtgcagtaactcaactcactgctattaatagtaaaactttctaaaagttatggggtatagagaccaaccttaaggagtagaaaaccttttacattggtaatattcattaagcagagtaaatgtgcaaaaaccattaaacagccttgttttctaaaatggattaaatttgtcccttgcaacattgtttacattactaattggctttgcaaacctttcttcagagtttaaacacttctgggacacaactggaccaatataaattttgatttacatgcaacagtatttatgcattaaagtacagatagcttgtacaggacaggtgtagtggctggctcatgcctgtaattgcaggactttggaaggctgaggctggaggattgcttgagcccagagtttgagattgccttgtgcagcatagtgagaccctgtctgtaatggaaaaaaaaaatttgtaaatagttgtacaaagatgtctttattattgctcatttcagataaaccctgtctctattctaattcctagtgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtagctcacgcctgtaatcccagcactttgggaggccgaggcgggtggatcacgaggtcaggagttcgagaccagcctggccaagatggtgaaaccccgtctctactaaaaatacaaagaattagctgggcgtggtggcgggcgcctgtaatcccagctactcgggaagctgaggcaagagaatcgcttgaacccaggaggtggaggttgcagtgagccaagatcgcgccactgcactccagcctgggcgacagagtgagattccatctccaaaaaaaaaaaaagaaaaaaaaaagaaaagttctgtgttgatgtacagtttctcctaagaagaagcgaggtggttgaattttggaagcacttcttgaatcggattaacccatgctcttattgaattttttcatctgctctgtttagtttgatattaaagcaaaattaagaggtcttagtttttcctatagaacttttaatatgtcaaaagctatattgtctaaatttcagtacttaagcaaatactgagtagtgttttaaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccct

SEQ ID NO: 111 - DNA, 10752 bp, Homo sapiens; identical to SEQ ID NO: 110

SEQ ID NO: 112 - DNA, 47689 bp, Homo sapiens
ctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgaggtgagctggaagtggactctcccggcctgatagtccggggagtcgcagtctttcgttgctgtgggaaggaggtcgcgttgcatcttgggaattgtaggctgtgaagtacttgctatgagtaggtcttcttcgcggaggcgcgtgttgcattctggggtgtgcagtctctttggttagggacagtgtgtgagggttgggggaagaagcgatgccatgggaacctgtgctttaaaacagctctttgggaggccgaggcgggcggatcacctgaggtcgggagttcgaaactagcctgacaatcatggagaaacccccgtctctactaaaaaataataattaaaaaaatatatagccgagcgtggtggcacatgcctgtaatcccagttacttgggaggctgaggcaggagaattgcttgaacctgggaggcgaattatatatataagtattatatattacgtattatataatatatatacgtatatattatatataatgtgtatgtatatattacatatataatatacatatatattatatataatatatgtaatatatattatatatattttcaactagaggtgtttatagttaaccacctgtaaatattcaacatattcatcataataaacgtacatttatttagcattttatatatgctagacactgttgtcttttatggagtttaattcatgaagtctttagaatgactaattgaaggaagtacttttccttttttttttttttttttgagacggagtctagctctgtcgccaggctggagtgtagtggtgtgatcttggctcactgcaacttccgcctcctgggttcaagtgattctcccgcctcagcctcctgagtagctgggattacaggcacgcaccaccacacctggctatttttgtattcttagtagagatgaggtttcaccatgttggccaggctggtctcgaactcttgacctcatgatctgcctgcatcagccttccaaagtgctgggattacaggcgtgagccaccgctcctggcagcattgcttcttgagcagtctccacatagctattttgtttgattagctgagaatttcatgtgtaaaaaactcattccacagtattcatttaacaaatacttattgggtgtctgctatgtgccaggaactgctctaggtacacggaataaacaaaactaaatccctctacttgggaagtttacattttagtgaagagacagacgataaacaagtgaaacagaaaaaaatcaggtggtggtaaatcctgtgaagcaaaattaatctgggaatagagagtgatgaaagggttaatctttgtttgtttgtttgttttgagacagaggaggagtcccactagctctgtcacccaggctaaagtgcagtggcccgatctcgggctcactgcaacctctgcctcctgggttcaagcgattctcctgcctcagcctcctgagtagctgggattataggcgcctgccaccacacccagctaatttttgtgtttttagtagagatggggtttcaccatgttggccaggctggtctcaaactcctgacctcaagtgatccttcccgctttggccccctaaagtgctgggattacaggcatgagccaccacacccggtcgaaagggttaatcttaaacagatgatcagggaaggggtctctggggagagagcctgtgaggagaaacacactgacatttgcccacagcataatgagtggttatgactcataggcttgtctcttgcatgcctgcgcttctcctcctccatttgagttgtgtgcttagtgagggtccattgtgtttttttctaaacatcatgtgtctgtgggctgggcgcagtggctcatgcctgtaatcctaacactttgggaggccgaggcaggattgcttaagcccaggggttcgagaccagcctgggccacatagtgatatcttgtctctgtaaaaaaaggaaaaaaaaaaagaatgaaaacaattttttaaatgtgtgtatggcacttatgcttacagttgcaactacgtaatttaatgaaataatacgaaaaatgaaatatgagtaccaaaaaagagggttgctattgctatgaaaactaagttgaaaatcagaaacacttgttgaagatgagtagctaagacaaattgttattgagttaattatgaacaagttaatggtaaaagcctaggagaaaaatttatagaaatctaaaaagattctgtagtgaagattgttttacaggtgtattcaagatgttcttccattttaaagaaagcaaaactagaaatctcagatggtatgttatgtgtctggtctgtttatgtaggaaagtgatgcagaatgccaatgaatatatcaaggaaaagccttggctttacattacaacagcccctgccttcaaggcaaccacaactcccattgagtctgttttctaaatgtctcacaaatcctttgtttctttttttcttggctacttctgtgtttcaggccatcctcattccttgcttagagtactgctgtgtcatcctaaccaatctctctgcctcattccccactctagtccacctgcttaccacatttctaaaacagaaaaatggatcatgccatttttctctagaattacacacaaagatgaattctaaaccctaacttttaagtctcagattagaagtcacttcttttagggacctttcctgaacacctacccctgtaatcagttagacactcctgccccactacatgctcccggagcagccaatgcttccccatcagcacttaccataaggtgatgtaagtgcctatgttccctttgtaacccctccagattctgagccccgttatcactcttaaccagagtaagggcatatgttaaacactcaacaaatgtttattaaatgagtaagtgaatgaagtagattgttggaacccttttttttctgccatcggtttgtaagtcaccatctcccatctataggagtttgaagtttacccttaaaagtagccacaggaggaacaggtactctcataattgttggtgggaatgcaaagtggtacagccctaaaggagaggaatttggcaatatgtagcaaaattaaaaccccacagtcacaaatcacagtcctgtgagtccatcccaaacatatgctggcaaaaagatgcaaagataggagatatttgtaacagtaaaagctatgagataagatccaagatttgagaattttttgtaccactacttaccgtggcaaaagactgggaacagcctccaaatccgtcagcagagaactgactgaataatgttatggtcacctgtagagtgtggtactctgcagttgtaaaagagcaatggattcattaggagatagcaattgaataggagattcaatatgtattgctgcagataaccctcagggatctattgcaaagtgaaaacagcaaggtgtaggctgggcacggtggctcatgcttataatcccagcactttgggaggctgaggcaggcaaatcacttgagcccaggagtttgaaaccagcttgggcaacatggcaaaaccccatctctacaaaaaaatacaaaaaactatctgcgcatggtggcatgcacttgtagtcccagctactctggaggctaaggtggaaggatcacctgagtccgggaggttgaggcttcagtgaacagtgatggtgccactgcgctccagcctgggtgacagagtgagaccatgtctcaaaaaaaaaaaaatatatatatatatagagagagagagcgagcgagagagagagagagagagagcaaggtgtaaacaagtacacatagtatgttacattttaagtaggaaagtggtatggaggaaaataaatacatgtgtccattgtttaaaaaggaacaatggaaagaaaaccacaaagctaataaaaatagttatgcatggggctgggtgtaggggctcatgcctgtaatcccagtactttgggaggctgaggcgggtggatcacctgaggatgggagtttgagaccagcctggccaacacagtgaaacctcgtctctactaaaaatataaaaattaggtgagcgtggtggcatgtacctataatcccagctactcaggaggctgctgcaggagaatctcttgaatccaggatgcggaggttgcagtgagccaagatcgcatcactgcactccagcctgggtgacagagtgataccctgtttcaaaaaaatgaaaattaaaaaataaaaaaatagttttgcatatgggggagagaacagggaaagaaagggacagagatggaaaatcctattttattgttttgactttagacatccagaaggggttactaactttaaaactttaaataaagttgccctgtgttggggaagaaatctggcaatcctagttactttgaagtcacgctacccttttcactagagtctccctgacccaagagaacagggaagggccggtaggatacacataacagtagctccttttacttggctgaatttaggtatgccaggagcagggtgcagtattaggccagaaatctctgttggtctctgcttgcctctcagtgctaatgtggtcagctctccttgactgtagaccatccagccaaatccaagctctgcttttctcttttggactcaggacccattaaactcagtaacctcattaaattctgcctgcacatttctcctttcttttcttttcttttttttttttttgagacagagtctcactctgttgccaggctggagtgcaatggtgcgatctcggctcactgcaacctctgcctcccaagttcaagagattctcctgcctcagcctcctgaataactgggattacaggcacgtgccaccacgcctggctaatttttgtaattttggtagaggggttttgccatgttggccaggctggtcttgaactcctgatctcaggtgattgcctgcctcggcctccgaaagtgctgggattacaggtgtgagccaccgcacctggccatctcctttcttttctttttcccagccctgtctggtcatcttttatggggtggttccccattttaagccctgagcttctcctcatggcttccccacaccccccactgtttctcttattccattttttttttctttttttttttttgagacagggtcttgctttgtcgcccaggctggagtacagtggtgagatcttggctcactgcaactttcgcctcctgggttcaagcaattctcccacctcagcctcccaagtagctgggattacaagcgcagccaccatgcccagctaacttgtatttttcggtagagatgcggtttcaccatgttgcccaggctggtcttaaactcctgacctcaagtgatccacccaccttggcctcccgaagtgctgagattacgggcatgagccaccgcacctggccttctcttatttcatttctaaatagctgtattcctctgtccttttcagccccattctaactcttgcatctttactactttcaaacaaccccaaatctcaaatctgcctttaaagaattacgagtcatgttctctcactggacttgtggagccaaagtttttttgcagacttctcttagcacttaatgaatacactgtgccaacagcccagcagttaggaagcacttgatttctcaggcagtggcctttgaaacagatgtcgggtccatgccagaactgccatagtgccaatgaaatgaattttcaacatgaacaaatagaaaattatccttcattacattttgagtgtttgtggttgtatagggtggaggagtgggagaggagagagggtagtagtgtaacagctgcagagagaagattacaggaagtttgggaattttgattattaccattttatttttgtcttccagctgctaggtcaggcagctcgaaacatggtactccaggaagatgccatcttgcactcagaagatgtaagaaacaacttttttttttaatgatttgggtttatgtatatggtttgtgtggccacagggaagtggaaatgttctatttctctctctcttttttatgcagagtttaaggaagatggcaataataacaacacatcttcaataccagtgagtatgccccctccagcaactatttgctgcagaatcattatccctggtctgctttcatggactttgtgcttcagcactttcctgtggaggccagagtgggagtaaaggtgggggtggccaaggatgactttctcgatggcaaagatgcctgagactacagaagaagtgggggtaaaggatgagaatcaggagcagagtccaccctttatgaacctccccatgttaaattgagggctcctcagagagagactataaaccctgtaaaggcagggcccgtgccaggaccatgctagcactgtacttggcacctgtgaggccgttgatcagtatttgatgactgactgtgcccaaggtctcttctgggaagttaagttgggtcctctactagggaatgaagtataacatacctgtatcctacatggtacataggtaagtgtggcacctgctacatataaatcatgtagggaattttgaaatataagaccccctctttctccattataatttgctcttcatcttatttcatgttgttttatattttatgtacttgatattatacttatgtacctcttagaaatatatggttggggctgggcatggtggctcacacctgtaatcccagcactttgggaggccgaggagggcggatcacctgagatcaggggttcaagaccagcctggccaacatggtgaaaccccgtctctactaaagatacaaaaaagtagccgggtgtggtggtgggtgcctgtaatcccagatactcagaaggctgaagcatgagaattgcttgaacctgggaggtggagtttgcagtgagtggagattgcacctctgcactctagccagggtgacaaaagtgaaactctgcctccagaaaaaaaaaaaaagaggctgggcacagtggctcatgcctgtaattccagcactttgggaggctgaggcaggtggatcacctgaggtcaggagttctagattagcctggccaacacggcaaaaccccgtctctactaaaaatacaaaaattagccgggtgtggtggcacacacctgtaatcccagctactcgggaggctgaggcaggagaactgcttgagcccgggagacggaaatggcagtgagctgagatcgggcaccactccactgcatcctggcgacagagtgagactctgtctcaaaaaaaaaacaaaaaaacaaaaacaaaagcaaacaaacaaaatatatatatatggttaggaatttcactcttcgatatttaaatagctaatgtttgtcataatcattagtcattctttgggtatctacatattaggtattaggtatgtgaccatttgattccatatacacagactaattttaagccatgcatgtagtctgttgaaccacatttctcactctgggagaatgttactatctgtttgggtttagattccatcttttcagcagctctgcactcagacaggaatccctgttcaatagcacaatcttaggataggatggacagaaatacaggatgtgacataagctgaaatttcttctgcctatatgtattatctggtcataaatgaaacttattagttcacttatgtgtattttcctctttccttttctgatttaggcaagaagctattcagaagaagtaagtaaccccaaaggtagaggagtagggaaccaactgaagcaggctggggggatttatactgctgggtccagaatcaatacaaaaccctggttgacacctgccctcaaattgaaatatgctctgggatactcacttgggatttaaagatacagcatatttcaaaggtgtgcagtaactcaactcactgctattaatagtaaaactttctaaaagttatggggtatagagaccaaccttaaggagtagaaaaccttttacattggtaatattcattaagcagagtaaatgtgcaaaaaccattaaacagccttgttttctaaaatggattaaatttgtcccttgcaacattgtttacattactaattggctttgcaaacctttcttcagagtttaaacacttctgggacacaactggaccaatataaattttgatttacatgcaacagtatttatgcattaaagtacagatagcttgtacaggacaggtgtagtggctggctcatgcctgtaattgcaggactttggaaggctgaggctggaggattgcttgagcccagagtttgagattgccttgtgcagcatagtgagaccctgtctgtaatggaaaaaaaaaatttgtaaatagttgtacaaagatgtctttattattgctcatttcagataaaccctgtctctattctaattcctagtgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtagctcacgcctgtaatcccagcactttgggaggccgaggcgggtggatcacgaggtcaggagttcgagaccagcctggccaagatggtgaaaccccgtctctactaaaaatacaaagaattagctgggcgtggtggcgggcgcctgtaatcccagctactcgggaagctgaggcaagagaatcgcttgaacccaggaggtggaggttgcagtgagccaagatcgcgccactgcactccagcctgggcgacagagtgagattccatctccaaaaaaaaaaaaagaaaaaaaaaagaaaagttctgtgttgatgtacagtttctcctaagaagaagcgaggtggttgaattttggaagcacttcttgaatcggattaacccatgctcttattgaattttttcatctgctctgtttagtttgatattaaagcaaaattaagaggtcttagtttttcctatagaacttttaatatgtcaaaagctatattgtctaaatttcagtacttaagcaaatactgagtagtgttttaaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatggtctaagttttcttcatgctggaacaaatgttaaagaagcagtgattgcttacaatgtatgtgataaaataatacctttcacaatcaaaattttaatagtaaatataagataaaatttatattaaataatgaaaacgtatttgtactgaatttagtcactagagaacatcgtaacaaaatacatgaaacaaaagtagccagaaatgttagaacaggtggaaatgtatacattatttgatggtttgtttttttatggaaataaacaacatacatagaattaaatggtgatcaaaaacatggaaaaaatacttcactaaataacgtctaagttgtagaggttgtgccggaagataatatttttaaaataacaaatgttcaaatgccataaaagaaaatttgtgtgataataccaaagcagtactataagaaaataagcatgctttaaatccctgtattagggatagagtggaaatatttttgttttttttaaggggtatatagttagaatttagaaagaatggaaatggaaataataaaactaaacaaattagaaaaaaataacaaattagaaaaaataaaaagtattaagtagttcttgtagattaaatgggtaaagtgtcagctcagccagaaaagtacaaattagtaaattcgtaattgaataggcaatacataaaatcaatgagatttgaaaagagttatcagtttgctgcaaaaaatgtgattaatatatgcccagctccttataaagataaaaaattatgaaactgacacttttaacagagaatattccagattggttatgagaaataacccacaaactaagaataaccaattaaaatggcatttgcttgtgaaagctttcatgagacttttccaaactgtcaaagaacatatactcctggccgggtgtggtggctcacgcctgtaatcccaccactttgggaggccgaggcaggcggatcacagagtcaggagttcgagaccagcctggccaacatggtgaaaccccgtctctacttaaaaaatacaaaaattaaccaggcatggtggcacatgcctgtaatcccagctactcaggaggctgagacaggagaattgcttgaacccaggaggcagaggttgcagtgagccgagatcgagccactgcactccagcctgggtggcagagcaagactccatctcaaaaaacaaaacaaaacaaaacaaaaaacccctatactcccaaaatatagaaaatgatcataagacactaattcatttaatgaagtaaacaggattttcattttaaaaataaaattatgtaagaaagatgatgcaagaggatgtaagataatgtaggtgatttttttatgagtatagatgcaaaaatccgaataaaatcttagaaaactgaatagagaaatattttgaataattgttcatgtaactccagaatttcaaagttgatgtaatagttacaaaacacattacattaataagaaataataaaatcttttgtcactataatatataccaaaaaggcatttaaaatacactttctatttcaaaaaaactaaaagaattttttaaaagggtatgttttaaaacccaacataatatttgatgaagaagagtcgtataaaaccccagaatattagagctgtatggggccttaaaagttattaaattctggccccatgttttacagatgaaaaaaacacagccaggaagatgaaatgacttacccaaggtcactgagcttgatggtaggtcttttgactactagtctggctctattacctgttagtttccttatgcatagaaacaagggtgccaccttcattactagtcttcaacataatactaaagagctcttagaaaaggaaaggatcttgaagtagctgaatccaatccatttgcccctgcttctgcatctcaggtgagccatcatccagtcattcatctgcttctgcttccgatatttggggaatcctttacttaggagtgctgatccttttggaaatctccacttcttgaaagatggttctgtgtaattaaccaaaatctgcctttctggataatcctggaattgtcactccagtagcttccaagatagaatgtgtgacggtgtgcacaggcctctgttaaagggtaggggagaaaatttctatgtatgttagttttttatcttaaaaaaattagcttttgtgaggctgggcgtggtggctcacgcctgtaatcccagcactttgggaggccgaggcgggcagatcacgaggtctggagattgagaccgtcctggctaacacagtgaaaccccgtctctactaaaaatacaaaaaattagctgggcgtggtggcgggcgcctgtagtcccagctattcgggaggtgaggcagtagaatggcatgaacccgggaggcggagcttgcagtgagctgagatcctgccactgcactccagcctgggtgacagagcgagactctgtctcaaaaaaataaaaaagcttttgccaatatttaaaatatgacttgatgtgagagtcttaatttcttctacgcagtatacagatatatagcattcctgtcatttagcaggggtgatagtaaaacaaaaaaacaaaaaaccccacaaaacctgtggtgaggcactgaccaatcagaatgattgatggtcacagtctggtccaaaattagcccccacaccagacaccatggaggaaaagtgagagtaactcaatttaagttgacagtggtttgttttattgcagtttatctgtgtgtgaataggtagatttaaggattgttggccaggtgtggtggctcacacctggaatcccagcacttttaggaggcagaggcaggcggatcacttgagatcaggagttcgagacagcctggccaacatggtgaaaccctgtctctactaaaaatacaaattagccaggcatggtagtgcatgcctgtaattccagctacttgggaggctgaggcaggagaatcgcttgaaccggggaggcagaggttgcagtgagccgagattgcgccattgcgctccagcttgggcaacaagagcgaaactctgtctcaaaaaaaaaaaaaaaaaaaaaggattgtcaaatgattcttgtaagtaaaccataaattaaagataacaaaacaagcacaagagaaaaatgatacagccctttccttgacctctcactaatctgcccttttaagataaagatatcattttaactatgagaaggtaactgcttttctaaaggagctcattttatgaagataatattttgaaaactaatatttaggagtgttttcaccattctatgattgcccaaaaactaagtgatacttataaaaacactaagttttatacatatactagttggaaatattccaagctgtagaaatattccaacaaggattatttccatggggttaatttgttaaaaatataaaagacaccacctttctattaatttgtaacaactaattgacatcagagaagatgaaaatttactagctggatatcaaccagatttttgtattattggcaactgagattgaaaaatgaatgaaagagtctacttcatccatttagatatcctttcacttggatctccctgtttccttactgtcctaatgaatagaaatgatcgttacaagctgggcatggtggcttgcacctgtagtcccagctactggggaggctgaggagggaggatggcttgaggccagagttgaaggatccagagatgattgcgcagtgacgctaagcttgggccacagagttgagaccctgtctctaaaaatttttttttaatttaaattataaaaagagaaatgcttgttacaaccacaaagggaaacaagatatacacatataattgtggaagtaaaaataaataatttaaaaatacttttgggtgctcgcttcggcagcacatatagttggaatgatagagaagatttgcatggcccctgcgcaagatgacatacaaattcgtgaagtgttccatatttaaaaaaacaaaaaatacttttgggcctggcactgtggctcatgcctgtaatccaaacactttgggaggctgaggcgggcggattgcttgaacccaggagttggagaccagcctggacaacatggtgaaatcccgtctctataaaaaaatacaaaaattaaccaggtgtggtggtgcacgcctgtaatccaaggtacttgggaggctgaggcgggaggatcgcttgagccaggaggttgggcctgggtaacagagaccgtctcaaaaaaatttaaaaattaaaaaaaaaactttctgcaagatgaagtgacaatacctggaaaatacatgtgacttgaccaaaaattactataggtgaaaataaatttagcaaagttgctttcctaaatacaacccaaaatagactgggaacagctacatactgttaatggttccctctatgtgacattctagaaaaggcagaactatagggagggaaaacatctgtggttgcccaggagctaggggtgggaagagggaatttactacaaagaggcacgaagaaacttgtgggccagagctattttggtctccgttttggtgatgtatatacgtttgccagagttcacagaactgcacactgaagaaagatggatttcacggaatgtgaattatatctcaacaaacttgacttcaaaaaacagatcgagaaaagatgattctattcccaaaaagggggaggggggaagatcattatataggtgagtgttcatttaaatcagagtacgagatttatccgtgaaaatcgcagtggagcgaacaagggggatgctgataccgacctcctggttggaaagcctgtagagcagcgcggatgacagtggaacagcgggtcaggcggtgggcgcctgagcgaggggctagagcgggatgggcgggcggagcaagcctgccagcctgggcggggcctcggcacaggagctggctgcgggagcccgccgtcctgagtcgcaggccgaggagacagtgagtgcgcgccctgagtcgcaggccgaggagacagtgagtgcgcgccctgagtcgcaggccgaggagacagtgagtgcgcgccctgggcgccccgccccagcccccagccccttccctgggcccccgcaaggcgggaacgcgagcgcctcccccgagctgtgtctcgagacctttgtcctcccctcacccctcggcccgctgcctgccctttactggccccctccctcatgcccgtccctcagcaccctctcctttcaactaactttcccgctcccgacagtggctgcacttcgtgacgctgagatacagaaggacgtgcaggtgagagctgtagggcctggaatggcccaagtggagcctaggctaatggaagtctggcctggcccgcaccctgtcccccgggactcctggagtcggggtagggcagggtctaggcttcgacctttccagggaactgaggtcggccaagtggaggtggaggtggtgacggagccctcgcgctgcagtcacagctcttctccctctctacccctcactccactgtgggacgctgggtcagacctactacgggcaggtgctgaagagatcggcagacctccagaccaacggctgtgtcaccacagccaggccggtccccaagcacatccgggaagccttgcaaaatgtacacgaagaagtagccctaaggtagagtgccctgtgctgtccccaggaagaccccaaacagcagttttcccaaaagataatgatgcaggtcactagggaattaacccgtagccaccaacccatcagcttgccttgtctattgtaaaaatcctaaatctcagcacccatcatcttactgctctaagaacctccgatgagtctgggcgcgccagtgagcctgtagtcccaagtgcttgggaggctgaggcagaggatcgcgtgagcccagaagttacaggctgtagtgtgcgatccgggatgtgaatagccactgcactccagcttggtcaacatagccagatgcatctctaaaataaatgcgtactttaaaaaaattgcctaaaaaaaagaacctccagcgtgaacactctgtagtccctacccatgctcacagaatacagtcacactcactggatctgccattcaagatatgcgcagttcagcacccactaatcaaccttggcccttttgacccttcccttcctcactccatcagcactgcctgcccagccggcagtcaccaatttggaaggtcttcccttttctttttccttcccaaccctgcgcatccagcaccacgctgctgtcccacctactgcatggagccttctctaatccttgagcggcctcttccccaaactgccacagcactctgtcactcggtctgtccgtaaatcacgggaagtgttttctgtgcacgatgttttatctcgcctctcaaatacacctacgcggcggggagcggtggctcacgtccgtcatcccagaacttgggaggccaaggcaggtagatcacttgaggtcagaagttcaagaccgacctggtcaacatagtgaaaccctgtctctactgaaaatacaaaaattagctgggtgtagtggggcacgcctgtagtcccagctacttgggaggctgagggaggagaatcacttgaacgtggaaggcggaggtcgcagtgagcggagattgtgccactgcactccagcctgggcaacagagaaaaactcagtcaaaacaaaacaaaacaaaaaaaaggccgggggtggtggcttatgtctgtaatcccagcactttgggaggccgaggcgggaggatcacgaggccaggagatcgagaccatcctggctatcatggtgaaaccccgtctctactaaaaatacaaaaatattatccgggtgtggcggcacgcgcctgtagttccggctgctggggaggctgaggcaggagaacggcgtgaacccgggaggcggagcttgcagtgagctgagttcgagccactgcactccagcctgggtgacagggcaagactccgtctcaaaaaaaaaaaaaaaaaaaaaaaaaaaaaaaattagccaggagtggtggcaggcgctcgtagtcctagctactcgggaggctgaggtaggagaatggtgtcaacccgggaggcggagcttgcggtgagctgagatcgcgccactgcactccagcctgggcgacagagcgagactccgtctcaaacaaaacaaaacaaaacaaaacaaaacaaatcaaaacaaaaaacgcctatgggacagaaaccttacattttttcctcaataactagcgcagtcctgggcctgaattagaagctcagctaatgattaaatgtatttattcaacacattattttattttatttatttatttttgagacggagtctcactctgtcccttaggctggagtgcagtggcgccatctctgctcactgcaacctctgcctcctgggttcaagccattctcctgcctcagcctcccgaggagctgggattacaggtacctgctaccgtgcccagctgattttttggtatttttagtagagacagggtttcactatgttggccaggctggtctccaactccttgcctcaagcgatccgcctgccttgacctcccaaagtgctgtgattataggcgtgagccaccgcgcccagcctgaacacattattttagatggcttatgaagtcttagtgcctagcacatgcccaacaatactgtggtaaagcagatacagtcccagccttcatgggtgtccagttcagtggagactaaacatcagaagtatgagtgaatgatgcaagaaagaaggaaggaaggaaggaacggagggagggagggaggagggaagtatgtataagatttagtggtttcatgtcttacagtctccagggaaaaaatatgtgttttccatttcccagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtgaggcatgatttggaagacaaggagaaaaagattctcaaaagcattatttgaaaaataaagttgttttcttcgtggctcttcaaggataatttaagaaagcttctagttagcaatgctcatttgtgccactagtgcttcctgtcttggaaactgataacttgaacaattaggggttcttctgggcgaacacaagagtcggaggtttgctctgatatgaatatcgtgacgatagagtggactttgatctttcccttcttgctgccatctatcctgaaagattttgttattgaatgaggagtttattcaagccaaactgcacgggcagcagggagtttatgtcccaggttgtagtatatcctacgtgtccacaggaatcttgtatgtttatccaaaataatctaggggaagtatattctgttagtgataggaaatttttaggaaaaagttgtgtatttttttcaaaatgttatcaaaactatatttttcttactttaggtggaagtggctgaaaagtatcttgactatcacatggaaaaatatggcttccaggcatctaatgtgacttttattcatggctacattgagaagttgggagaggctggaatcaagaatgagagccatgatattgttgtgtaggtctatattcttactgttatgactatagcccattttctttattattattattattattattgagatggactctcgctctgtcacccaggccagagtgcagtggcccaatgtcagctcacgataacctctgcctcccgggttcaactgattctcttgcctcagcctctcaagtagctgggattataggcacacgctaccacatccagctaattttttaaatcttcttttagtagagacagggtttcaccatgttggccaggctggtctcaaactcctgatctcaggtgatccacccgcttccacctcccaaagtgctgggattacaggtgtgaggcactgtgctcagccctcatttccttttgaacacagagatgtcactattactgtttgctgaattgactctcatttagggtgttaaactaaacttagcatggcttactaatgggagagagctggtttgagctgctggagctcaccagcagcagaacacaccagaccaagagggaacttacttgaaacttaaccacaaaccaatgaacccaaaagaccagcaggaccactaagtttgctcctacaatacatgctgacctgtatctttcataatattttcatggtaaattataggattctatttccttttttccctcaagttgttattgtcaaatcatgcccaagtgacagctgcctttgaggaacatagcctgtttacgtgaagcataagaaatgccttgtgccggccaggtgcggtggctcacgcctataatcccagcattttgggaggccgaggcaggtggatcacgaggtcaggaattccagaccagcttgaacaacatggcgaaaccccgtctctactaaaaatacaaaaattagctgggtgtggtggcacatgcctgtaatcccagctatttaggaggctgaggcaggagaatcacttgaacccgggaggcggaggttgcaatgagccgagattgcgccattgtactccagcctgggcaacaggagtgaaacatcctctcgggaaaaaaaaaaaaagaaagaaatgccttgtgcagtaggcatctggtctgaggtttcatcttgttacatggtgaacatcaggacagaaacaagtaagaatcatgcctgatgttattttctgcacattcaaacttgctaacaatttattgagattttaagcactctgtctctgatcttggggaaaagcttagttgaaggcattagaaagagaggagggaggcggtaagaatggggtagctttgacagaacggtgggaaccacctttagggtctgaaaggatttgcagatctctgagtgttgtgaagatttgctcgacatttcatctgttctcttttagatcaaactgtgttattaaccttgtgcctgataaacaacaagtgcttcaggaggcatatcgggtgctgaaggtgaggaggagagtgagataaattatctttgaacatcagtaagagctgatgggttaagtcttgtttgttcccccttgaactaagagctcaaactctcttaatttatccattaaatgaataaggggtggcaaaagggggaaggggcaggaataccccggatatggattactttccctcttaggttgcaaaaggtagtaaatccgaggtgacagttgtcactgaatgtgttaaggtatttgctttcttgactgtctctcctatttgctgctgtacatgatcctagaagagcatctgtggagctataggaatctttgcactgactactaatgattgctttgaatatactctcttctagcatgtacagtgtttctcagggcttctgatttcttatctgtcatgatttcagatctttgggaagttacagaagatggaacttttacattaactacttgctaaaaggaaagcttgcaggagctccacagccttcattgtatcatgagatgtgtatcttcatgatagtagatgaaatattcagccaggtgcggtagctcacacctgtaatcccagtgctgtgggaggccgaggcgggcagatcacctgaggtcaggagtttgagaccagcttggccaacatggagaaactctgtctctactaaaaatacaaaaattagctgggtgtggtggtgcgtgcctgtaatcccagctcctcgggaggctgaggtaggagaatagcttgaacccagaagtcagaggttgcagtgagccaggatcgtgccactgcactccagcctgggagacagagcgagactccatctcaaaaaaaaaaaaaaaaaaaaaagattctagctgggtgggtggtacatgcctgtactcccagctacttggatgctgaggcaagaggattgcttgagctctggagtttgtgtgcagcttgggcaatatagtgtgatcactgcctctaaaaaaatgtttttttttttgagatggagtctcactctgctgtccaggctgtagtgcagtggcaggatttcatctcactgcaacctccgcctcctgggttcaaacaattcttttgcctcagcctccctagtagctgggactacaggcgtgtgccaccatgcccagctaatttttgtacttttagtagagacaagatttcaccatattggtcaggctgatcttgaactcctgatctcatgatctgcctcagcctcccaaagtgctgggattacaggcatgagccgctgtgcctggccaaaatttttttttaaattgacaacagatttttgagatttttggtttacaaagctgtcatagaactcaaatacaaatatctatatagaaatgatttaatgatttagtgatgtctttgttagtatgtcattttacacgccagttcactatctccaccaaaaatgtacttataaaaggtagaaacactattatagaatctagatctccaggtttccaggtttttgaaattagctaaataaaatgttaagttcctgatcactcatttgccttacattttaaggataatattttaaagataaaatgtgttgttataaaagtaaataacaacattacaaaaagttatattttttaatagaaatggggtcttgctgtcacccaggctggaatgcagtgtcactatctgtacccctctaactcctgagttagaggggtccagatagtgacactcactgtaccctctaactcctgggctcaaacaatcctcttgagtagctaggactccaggcacatgccaccatgcccagctagtttttaaatttctatatgggagagagggtcttgctgtgttgccaaggctagtctcaaactgctctcctccagcaagcctcccacttcggcctcctgagtcattgggattagaggcctgagccatcatacctggcaaagttatactattcttaagagataaaagattatgaatactgatgatatcctctgttctacaatgacctggggctgcttttggttcagattggctaaaaatttaaatgtaagtaacctgaaaatctttatttaggagacagacactcttagaatgtgattttattacctgttggataagccactgggaggaaaaaaaaccttggcacttgactattgattgtaactaaagaggcagctgctatttgttcacaaagggtcagcttaaacattgctattgatttttaaatttgattttgttcccctattcctttctttgttatgtggggtcaatgtaatcattaatcatcttgtttggactaatatgcctctgtttcagcatggtggggagttatatttcagtgacgtctatacgagccttgaactgccagaagaaatcaggacacacaaagttttatggggtaggtgattttgtttagtttagtattaaggcagatggttgtacatgtgcagaactcctttctgctaatagccaggatgaggctatatgagatcacatggggttaggccatgaggccaaggttccattcttcctctgccattcaaaagtgatagggctttggatagtttaattcatctctttgagttatcgttttccaaattgtaaaatgtaaataataatacaatctgccttatagggctgttatgaagattaaatgggataaagaatgggaaaaatactttgaaaactctagtgtggaaatgaggacaattgttcccaagctggtgtcctcttagtccccttatgttctcatcattattgtgttctttattcctttattatcattttaatagtctggaagttgagataaatgcatgcttttcatcagtctatgaaatcaaaagttcttattcttaaaataatattaactttattcttactatgtaataataaataggtaccgttaacaagttggaaagtgccaaaaaaaaaaaaaaaaaagaaaaaattactaagctggacacagtggcacacacctgtaaccccagatatttgggaggctgagtcaggaggattgcttgagcctaggagttcaggtacagcctgggtgtcatagtaaaaccctatctcttaaaaaaattacttataatcatataacccagtgataacttcttttttttttttttttttttttgagatggagtctcgctctgtcacccaggctagagtgcagtggcgcaatcttggctcactgcaacctccacttcccgggttcaagtgattctcctgcctcagcctcccaagtagctgggattacaggtgcatgccaccatgcccagctaatttttgtatttttagtagagatggggtttcactgtgttggccaggctggtctccaacacctgacctcatgatctgcccacctcggcctcccaaagtgctgggattacaggcatgagccaccgcgctcggcctatgatttattttttatactactttattcacataacagtgcttttcagaatgtggcgtactgcatacatgaatattatgcttgcagctgagtagaaccaatccaccagtgagtgtcctgaagaatggttcctagagaccatcagctagcacacccagtcttaaccatggctttctagaccttggagggatgctcaagttagcttctactgctaggatctatgttttaactaataccatgtcctaattaattatatagaagaatagttcccttaatactgtattaagtgttggctggtctgtggttttttgttgttgtttgttttttaggtgagtgtctgggtggtgctttatactggaaggaacttgctgtccttgctcaaaaaattgggttctgccctccacgtttggtcactgccaatctcattacaattcaaaacaaggaactggaaagagttatcggtaagatatgacagacagcagggactattataactacagcttgaatgattgaaatgtggtgattagtaagtaacttctgaaggagtctcattgagggatactttctgttatctggaaatagctatcttgcctcctgtacaatggtaaccccccaaaaattttgatatttaataaagcactttgaagtcattcagtaaatagagtgaagtgctcagaaagataactgatgacatgcaaggaagaaaatcatctttataacgtgtttgctccttgtctgctgagcaaggcaacaactgggggagtgctggagatgaaccgtgaataaattctatttttaggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggtaaataaaacaatttccatgacttctggtattctttctgctcttgcccttgctccagctatcttttcttgactttgcattgcctcccatttttctggtgttggtttgtttgtgtgtgtgtttaaatgtatgtgtgtgtttcaagtggagtaaaaaagcattttttccccaatacttatttatttattgacagggtctcgctctgtcacccaggctggagtgcagtagcacaatcatagttcactgcagcctgacctcctgggctcaagcgatcctcccacctcaggcttctgagtagctaggactacagactcatcaccacacctggctaatatttgtattttttgtagagatggggttttgccatgttgcccagactggtcttgaactcctgggctcaagtgatgtgcccacctcagcctcccaaagtgctgggattacaggcgtgaaccaccgtgcccagccctcaatatttattataaaaatgtttttggccaggtgcggtggctcacacctgtaatcctagcactttgggaggctgaggcaggcagattacctgaggtcaggagttcgagaccagcctgacgaacatggcgaaaacccatctctactaataaaaatacaaaaattagccgggcgtggtggtgggtgcctgtaatcccaactactctggaggctgaggcaggagaattgcatgaacccgggaggtggaggttgaggtgagctgagatcatgccattgcactccagcctgggcaacagagtgagactccatctcaaaaaaaaaaaaaaaaaaagaagtttttgaatacagaaaagttaatagtacaatgaatacccacataggcattacctatatttcagcaattgagaacatttttccatgtttgtgtgtttatatgtgtatatatatatatatatttatttgctgagccattgaaaataagttgcagatattatgacattttacccttaaatatttcagcatgcgtcccataggaatgtaatatccctctgcataatcacaataccattacacacctaagaaaactttttacaagaagcctcattcagacattggattaatagggctatagagaagtaggatggaaaagagtaggagtatgtacaatagtatttcaattgtttaattgtgtcaaggaattaagaaattttaatgttggatgatggcactaattggcatttttactgccctgtgcatagtaagatttgttttctcaaaatggaaaagttcaggctttggaatcagatacctgggttcaaattctggctctattattattgttttttatttttttttctgaatgtcactagacaaacttttattgaagcataaattgtggtacagaaatacattttaactgatttaagtccaacaccagtgaaaggagagattatggcaccaaaactttccctttcctatcataccatgatttagattatgatgcaatctacatttctcttttctaggctttgtcccatacaaatttgggcagtttttcaacattagaatttcaacattagaattcttaattctattaggaaaaaaagcaacaaaaaaaccagacctcaagtcaacaaatctattggatattgtttatgaacgaagtccacgttaagcattggtcctcaaaacagagctcctcaaaatattaggtgctgtgctcattacagaatcaaactgatcacactgattgaaaacttcctcaatgaaattttcaatcaacaacatgcttcaaataaaagtcaaacagtgttccaaccacttgacttcaaaccaagtagattttaggtttagaaacactaaaaaaaggtgtttcatttataaatacagaaggaacaaaaacatcactgcatcaatccagaaattatcaaaatatttagaggacaagaaatataaaatttagtcaactttgctgctttctcagttccttaaaatcccagagtatctgcaaatatagctaaaaagtaccaactcttgaaagcctatattactagtcatttcccattgagtattttggaattttatttatgttctacttatttattcatgtattctgctttatgatgtttatctgaataatctggacaaattctcattctgggcagtcattcgtttcatcctatgaatgccatggtgagggaaacagtgtagttagaggaacagatgaagtcagaacactcacatgcatcacggtcacagaactttaagtcacaagacagaaaagaaatcgattctgctttggatcaaagtttatagaacactacttaatggaaactagtggaaatggctgctaaaggaaaagttaaggtgaatgatccaagctgacttgattactgaatccagaacaaaattatgctaaatctctctggtaattaactaaataaaaatcattttatactattatttagtaagttagtaaaggcgtgctactcattagatgctaatctcatttactgaggaacacagaattgtatatgttttctggctctattatttattacttgggtaaacttgaacaagtcaccaaaattcgttgggttacagtttgttctactgtaaaagcagggataataatacttactttgcagaatttctataaggattagcaataatgtagcaaaacactgggtacatactgcaagttcagtgaaaagaagatactgtcattatttgttccaaaagtggaagaacttactattaatatttcatttttctgatttatttatttatctattttagagacaaagtctctctctgtcacccatgctggagtgtagtggcacagtcatagctcactgtaacctcaaactcctgggctcaagcgattctcccatctcagcctcccaagtagctgggactacaggcatgtgtcaccatgcctggctaattttttatttttatttttttgttggtgagacaggttttttttttttttcttttttgagaccaagtctcgctctgtcactcaggctggagtgcagtggcccgatctcggctcactgcaagctccacctcccgggttcacgccattctcctgccttagcctcccaagtagctgggactacaggtgcccgccaccacacccggctaattttttgtatttttagtagagttgggatttcaccgtgttagccaggatggtctcaatctcctggcctcgtgatccacccgcctcggcctcccaaagtgctgggattacaggcgtgagccaccactcccggccaagacaggttcttatattgcccaggctggtcttgaactcctggcctcaagcaattctcccacctcagcctcccaaagttgcaagcatgtgtcactgtgcctggcttcttctgatttttttggtctaaatagcatctccagatttcttttttttttttaatttaaaaaatgtatttatttctttatttagacacagggtcttgctatgttgcccacactggggtacactggctattcacaggtgtaagcatagcccactatagtcttgaactcctggcctcaagggatccttccacctcagccttccaagtctgggactacatctggctaagcatcttcaaatttcttatttatttatttatttatttttgagatggagtcttgctctgttgcctaggctggagtgcagtgactcaatctcagctcactgcaacctctgcctcctgggttcaagccgattctcctgccttagcctctcgagtagcagggattacaggcgtgtgccaccacacccagctaatttttatatttttattagagacagggtttcaccatgttggccaggctggtctcgaactcctgacctcaggtaatctacccgcctcggcctcccaaagtgctgggattacaggcgtgagccactgtgcccggctgcatcttcaaatttcttaaatactccttggtatagtggagcccttaatgcttttcactaatgcactgctccttgatgtgctgcctattccagtagatacacagaatcagagtggtaagggcctttgaaaccattgatttgttctagtggctttcaaaaaccatttttaatacaattattttttaagcaaaatgttttatatatatatatatatggtttttttttttttgagatggagtcttgctctgttgcccaggctagagtgcagtggtgcaatctcggctcactgcaacctcagcctccctggttcaagtgattttcctgcctcagcctccccagtagcttggactacaggtgggtgccaacgcacctggctaatttttgcatttttagtagagacagggtttcaccatgttggccaggctggtcttaaactcctgacctcaggtgatctgcccacctcggcctcccaaagtactaggattatagatgtgagccactgtgcccagccagaaatgcactttaaaaaccaccagtccttgcctgggcatggtggctcacacctgtaatcccagcactttgggaggctgaggcgggtggattacctgaggtcaggagttcgagaccagcctgatcaacatgatgaaaccctgtctctactaaaaatacaaaaattagccgggcgtggtggcgtgtgcctgttatcccagctactcgagaggctaaggcaggagaatcggcttgaacccaggaggcagaggttgcagtgagctgagattgagtcactgcactccagcctgggcaacagagcaagacttcatctcaaaaacaaacaaacaaagaaaaaacccccaatagtccaaagccctaattttccccccattatttatttttttaatgggcaaattttaaaaattgtatatatatttatggtgtacaatgggatgttttgacatatgtatacattatggaatgactaaatcaagataattaaaatgcattacctcacatactcaccatttatttgtgatgagatcaaagtctactcttttagcaattttcttttttcttttcttttctttctttatttcttttttttttttttttgaggcagaatcttgctctgtcgcccaggctggagtgcagtggcacaatctcggctcactgcaacctccacctctcaggttcaagcgattatcctgcctcagccttccaagtagctgggactataggtgtgtgctaccacacccagctaattttttgtatttttagtagagatggagtttcaccatgttggccaggctggtcttgaactcctgacctcaggtgatccccctgcttcagcctcccaaagtgctgggattacaggcgcgaggtgcccagccttttagcaatttccaatacattgttattaactatagtcaccatgttgtataatagatctctttaacttattcctgataactgaaattttgtatcctttaaccaacatctatcctgttccacccctgccctcccaccccctacccccagcccctggtaagagcctctactcttcacctctatgagttcaactttttgaaattccacatataatctagcgaggttatgcagtatttgtttttcagtgcctgcagatatgacatttttgggttcaactttttgtttgtttttgagatggaatctcactcttgtcgcccaggctggagtgcagtggcgtgatcttggctcactgcaatctccgcctcctgggttcaagccattctcctgtctcagcctcctgagtagcagggattacaggcgcctgccaccgtgcccagctaatttttgtatttttagtagagacggggtttcactatgttggccaggctggtctctaactcctgacctcagacgatctgcctgcattggcctccaaaactgctgggattacaggcatgagacactgcgaccggccaaacatttttttaatgcataatagatgtacatactttcagggcacatctgataatttaatatattcatataatttgtacagatcaagtcaatgtaactggtatatccatcgccttaaacatttgtcttttctttattctaggaacccatttgaattattcttttctagctattttgaaatatacaatagattattgtgaactatagtcaccctactgatccatcgaacactaggtcttatttcttcttattaaactggattttgtactcattaatcaagctctcttcatcctccccactctacctggcgtctggtaaccaccaatctactctctattatcatgaggtccacttttttagctcccacatatcagcgagaacatgtaatattcgtctttttgaggttggcttatttctcttaacataatgacctgcagttccatgcatgttgctgcaggtgacaggatttccttcttttattttattttattttatttttttgagacagagtcttactctgtctcccaggttggagtgcagtggcgtgatcttggctcactgaaacctccggctgccaggttcaagtaattctcctgcctcagcctcctgagtagctgggactacaggcgcgtgccaccacacccaactaattttttttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccactaatttttgtatttttagtagagatggggtttcacatgttggcaaggctggtctcgaactcctgacctcaggtgatccgcctgcctcggcctcccaaagtgctgggattacaggcttgggccaccgcaccaggccaggatttccttctttttcaagtctgaatagtattccagtgtgtacatatactactacgttttctttatccgttcatctgtttgagtcttctttttttcttagtttagctaaagatttattttattttttcaaaaaactaatttttcattttgttgatcttctgtatttttttagtctcaatttcatttatttctgctgtgatgttctttctttccttctactaattttgagtttgatttgttcttgcttttatagttccctcatgggcattactaggttgtttatttgaagtctgttccttctttccttcattccttccttcctccctccctccctccctcccttcttccttccttccattctttcttttttttttgagagggaatctcgctctgttgcccaggttggagtgcagtggcgcgatctcagctcactgcaacctccacctcccgggttcaagcaattctcctgtctcagcctcccaagtagctgggattacaggcatgcaccaccacgcctggctaatttttttgtatttttagtagagacggggtttcaccatattggccaggctggtcttgaactcctgactctgcccgcctcagcctcccaaagttctgggattacaggtgttagccattgtgcccggcccttctttcctttcttcttctttctttctcagggtctcactctgtcacctggactggagtgcagtggtgcaatcatggctcacagcagctttgacctcctgggctcaggcaatcctcctaccccagcatcccaagtagctgggactaaggctaccatgcctggctgatttttgtattttctgtagagacaggctttcaccatgttgcccagtctgctcttgaactcctgggctcaagcaatccacctgccttggcctcccaaagtgctgagatcttatttgaaatctttcaacttttttgatataggcattacttgaaatctttctacttttttgatataggcatttattgctataaactttcctcttagtgctgcttctgctgtatcccatagatttttgcatgttgtatttccattttcatctgtttcaagatattttaaatttttctcctaatttcttcatggacccattggctattcaggagcatgttgtttaatttccatgtgtttgtgtattttccaaggttcttgttattgatttctaattttattccatagtggtgagaaagatacttgttatgatgtctacttttctgaatttgttaagacttgttttgtggcctaagatatagtctatgctggagaatgttccatgtgctattgagcagaatgtctattctgcagcagttgagtaaaatgctctgtgaatgtcagctaggcctatttgagctagtatatagtttaatgtttctttattattttctgtctggatgatctgttttactgagagtgaggtgtggtgttagagtcccctactactattgcattacagtatatctcttcttttagatctattaatgtttgctttatatactttggagctccaatgttgagtgcaaagatacttatatcttcttgctgaattgacccctttatcattatatagtaaccttctttgcctctttgacagccttgattcacagtctgttttatctgatgtaagtatagctactcctgttcttttttggtttccagttgcttggaatgtcttttttccaccccttaacttccagtatttttataagtaaagtaggtttcttgtaggcagcatataatttggtcccatttttgtatccattcagccactctattccttttttttggggggggttcccaagttttattcaagaactcataccaaatattccagataaataaatttttatcttcaccttcctcctcttctttttccaggttaatctggaattaacgtcattcataataactctttttgctgttagcaactacacacaacaaatcacatagattattcttcaaatattttttggtgagatatttcaaataccttttggaaaaaggtacctcagaagtcacagtgatcttgctgttgctcctttcgatggttataatgctccaccaagattcccagcttttccattcactttaatcctctcttgcaaaaactgctcaaaattggcagcatctatgattccattttctacaaggtgggtacagtcaagagtgaacatcataacctgcttctttttttgcctctctttgccacaagctttttcacagcactatgcctcttaattggagaattgagtccatttacatttagtgttattattgatacataaagacttaacatttttttaaattgatacataattgatgtagctattttggggcgttcatgtgataatttaatacattcatataatttgtaaagattaaattagtgtaattgggatacctatcaccttcaatatttgtcttttcttttctttttttttctgtgagatggagttttgctttttttgcccaggctggagtgcaatggcgcaatctcggctcactgcaacctccacctcccgggttcaagcaattctcctgcctcagcctcccgagtagctgggattacaggcatgcaccaccatgctcagctaattttgtatttttagtagagacggggttttaccatgttggtcaggctggtctcgaactcctgacctcaggtgatccactcgccctggcctaccaaagtgctgggattataggcatgagccaccacacctggccctgtcttttctttatgttggaaacattcaaattattctcttctagctattttgaaatatacaatatattattgtaaactagtcactttactgatatatcaaacactaggtcttatttctttcatcaaaccctatatatatatatatatatatatatatatatttttttttttttttttgagacggagtctcgctctgtctcgctctgtcgcccaggctagagtgcagtggcacaatctcggcccactgcaagctccgcctcccgggttcatgccattctcctgcctcagcgccccgagtagctgggactacaggtgcctgccaccatgcccggctaattttttgtatttttagtagagacggggttttaccatgttagccaggatggtctcaatctcctgaccttgtgatccacccacctcggcctcccaaagtgctgggattacaggcttgagccaccgtgcccggccaaaccctatatttataaccattaatcaacttctctttatctcccccattctgtaccctttctggcctttggtaactatcaatatactctctatcttaatgagttccactttttttagcttccacatatcagtgagaacatatgatatttgtctttctgtgtttgccttatttctcttaacatgacctgcagttccatgcatcttgctgcaaatgacaggatttccttctgttttaaaatctgaatagtattccattgtgtatatatgccacgttttcctcatccattcatccattgctggatgcttaggttgattccatatcttggttattgtgattaatgctgcagtcaacattaggagtgcagatatttccctgacatactgatttcatttcattcccttcccttcccctgcctgtctgcctgccttccttccttccttccttccttccttcctttcttccttccttccttcccttcctccctccaccccccccgcccctttcagatggaatctggctctgtcgcccaggctggagtgcagtggcgcaatctcagctcactacaacctccgcctcctgggttcaagcaattcttctgcctcagcctcccgagtagctgggattacgggcatgtgccgccatacccagctaatttttttgtatttttagtagaggcagggttttaccatattggccaggctggtctcgaactcctgacctcatgatccacctgcctcagcctcccaaagtgctgggattacataggtgtgagccaccgtacacagccagtttcattttcttttcttttttttttttttttgagacggagtctcgctctgttgcccaggctggagtgctggagtgcagtggcacgatctcggctcactgcaagctccacctcccgggttcacaccattctcctgcctcagcctcccaagtagctgggacaacaggcgcctgccactatgtccggctaattttttgtatttttttagtagagatggggtttcactgtgttagccaggatggtctcgatctcctgaccttgtgatcggcccacctcggcctcccagagtgctgggattacaggtgtgagccaccgcgcctggcccattttctttagatatatacccaagtagggggattgctgggtcatatagtagttctatttttaattttttgaggaatctccatactgtttcccataatggctgtactaatttaaattcccaccaacagtgtgtaaggattagtgctggtgaggatgtggagaaaacgatacttctgggcattttttcttctattgagactaaagttgcaactcttagtatttttttttatactaccctttaggaaggtgaaattgttgaagtggatgaagaaacagcagctatcttgaagaattcaagatttgctcaagattttctgatcagaccaattggagagaagttgccaacatctggaggctgttctgctttggagttaaaggttagtttggctttcactacctgagagaactattttatttatttatttttgagatggagtctctctctgtcacccagactggagtgcagtggtgtgatcttggctcactgcaacctccgcctcctgggttcaagcaattctccctgcctcagcctcccgattagctaagattacaggcacccaccaccacgcccggctaatttttgtgttttttagtagagatggggtttcgccatgttggccaggctggtcttgaactcctgacctcaggtaacccacctgcctcagtctcccaaagtgctgggattacaggcgtgagccactgtgcccggccagtatgcatggtctcttgaggcgcacttctcttgctggtcaaatgttgttagacggttatataccagttaaacgccaccattttgcctcttaatgtgcatgcttgagcccacttgcccaactcccgagatcttatcgggaagctgctgatcaccagtttcaggtgtttctgtttattgggagacttcctttccctggtactgtctgtgactaattatgattttcgagagacagttaacaaccacctgatcatcacctaatgatcgcctgacattcctggtggagtcggcgcggggagccctctcctgccctgctcacgcctgactagctattatacctgctttaacaagttctccaaaattcagagacctttcgtgagtattctgattttataataaaatagttatttgcataagtttagtaagagtcttttctctcaaaacaggacaattggagacacttggttattttaccaaagctttgactggaataacatttgtaggtaaagttccagcaaagccaacttgaaaagagcctatctggccaaactcttgctggacttcatgcaaatgatcaggcaaagtttaataagcctaaaatttattttgcacataaattggccttactataatttgtctttagtataaaaggaggagctgggtgcagaagttcacactcataatcccagcactttgggaggctgagacaggcagatcacttgaggccaggagtttgacaccagcctgggtaacatgttgaaaccctgtctctaccaaaaatacaaaaaaattatctgggtatggtggtgcatgctggtagttccagttactcaagaggctgagatgggaggattgcttgagcccagggaggtggagggcaatgagccaagactgcaccactgcactccagcctgggcaacagagtgagactctgtctcaaaaaaaaaaaaaaaaaaaaaaaaaagaaagaaggctagagagagaaatggtttcaaaggaaaactataacacttgttactagatttccagcctggacttttgtttttgagtgcatattgaatcattaattatttcttggctacaataaccctctaaagataaaccaggttataatttttcttcatgtttttagtttgtgccctaagtggaataggttccttattctgttctgacacacgaatactcttttgactgtcatattattaatgttatttatagctccttgttttacttccaaagaaaccagaatcatgatattctaaggttagagaatcccccgtttggaatcccactggtcctaatctgcttttcactgcaaattccgtgctgctaaaattatataagcactcttctctaggcccagggacctatcacacaaaaggtaggtgtgtgagactgtaagggccagttttgagagaattatttcagactctccaaatcaaaaatgggcacacagatgcataaacagctggtaaaataagggactctgcctcctgggttattatgtgtgtggcaccttttcatccatcccaatcataaagaatttcctgcttctcgtagaatgaaaagaaaattattactgagaggatataaaggtacctcatgtcaaagcctcctaggtttaatactctgagttatgagatttatgcagataacatatatattttttaaaattttagaacaggccaggcacagtggctcaagcctgtaatcctagcactttgggaggccaaggtgggcagattgcctgagctcaggagttcaagaccagcctgggcaacatggtgacaccccatctctactaaaatacaaaaaataaattagatgggcatggtggcgtgcgcctgtagtcccagctacttgggaggctgaggcaggagaattgcttgagcccgggaggcggaggttgcaatgagacgagattgagatggcgccactgcactccagcctggcaacagagtgagactctgtctcaaaataaataaataaataaataaataaataaataaataaataaataattttagaacaaattactgaaagaccacaaaaaaaaaaactgtagcacaacggaagtctctaaattccttagcttaaaaggttttaacagtgcttatgttttgtatagctaattgctgtaagtctgtaactaaaaccaagattacagtagcacaatgcatagaagttaaagataagtcaattttttaacctcacctttggctttttgtttgttggcttttatattaagaaattttaagggtttattaatgcctatccacatccattcccatctggcctagaactttcttttttttggtgggggagggggacggagtcttcctctgtcacccaggctggggtgcagtggcgtgatctcatctcactgcaacctccgcctcacaggttcaagtgattctcctgcctcagcctcctgagtagctgtaattacaggcatgtgccaccatgcctggctaatttttttttcttttttttttttttttccgagatggagtcttgctctgttgcccaggctggagtgcagtggtgcgacctcggctcactgcaacctctgcctcccaagttcaagcgattcttctgcctcagcctccagagtagatgggactacaggtgcgtgccaccatgcctggctaatttttattttatttttttagtagagatggggtttcatcatattggccaggctggtctcgaactccttacctcatgatccacccaccttggcctcccaaagtgctgggattataggcatgagccactgtgcccagccctaattcgtatttttagtagagacagggtttcaccatgttggtcaggctggtctcaaactgctgatcttaggtgaccaacctgtctcggcctcccaaagtgctgagattacaggggtgaaccaccatgcctggtctggcctagaactttcaaattcgctatgtgtcttttggctctaagccccttgaccataggggtcccaccaaggcacaagatggacccagggaaggcagctgtgccaccccagcaacacagtgagataaaataaaagtttggtgaccattgatgttgcctctgacaaatctaggccagaatgcggagaaagtaaatcaaaaataaaattctaggccgggcgcggtggctcacacctgtaatcccagcactttgggaggccgaggcgggtggatcacaaggtcaggagttcgagaccagcctggccaacatagtgaaaccccgtctctactaaaaataaaaaatcagccaggcgtgggggcaggcacctgtagtcccagctacttgggaggctgaggcaggagaattccttgaacctgggaggtggaggttgcagtgagccgagatcatgccactgcactctaacctgggcgacagagcgagactccatctcaaaaaataaaaaaaaataaaaaaataaaaaaataaaataaaattataaaccctcaaccatctgaacggacccctcctgtcgggcaaaggcattgcaaagttatcctaaaaaactagttcaggtcacgaagggaaggagaagtttggacatgcctcattattccctcctcccttttggaattcagacactgctgaccagcattaccattaaaacagatcttaagactgatagaacagactctttaaatctggtaagaaacatttacaatctattctctctgtagcctgctgcctagaggcttcatctgcatgataaaaccttggtctccacaatctcttatcataacctagacactcccttctattgatcccaggtctttggattataactcaaccaattgccaatcacaaaatctttgaatctgcctgtgacctggaaatccccacttccagttgtcccacgtttctggtctgaaccaatgtacatattatatgtattgattgatgtcttatgtctctctaaaatgtataaaaccaagttatagggtgaccactttgggcacatgtttgcagatctcctgagggctgtgtcacaggccattggtcacttatttggctcagaataaatctttttaagtattttagagtttgaccctttttgttgacaatgtttaacatcctacagttatgacaccctaatttgaatttatacagcttaacttcaataacatactaaaattctgctcctttaaagcttgttctcaactattttagttcttttttttttttttccattgacagagtttcactctatcacccaggctggagtgcagtggcacgatcttggctcactgcagcctctgcctcctgggttcaagtgattctcctgccccagcctcacaagtagctgggattacaggtgcgccagccaccatgcctggctaattttttgtatttttagtagaggcggggtctcatcatgttggccagcctggtctcgaactcctgacatcagatgatccaccagcctcggcctcccaaagtgctgggattacaggtgtgaactaccacgcccgggtctttctagttcttgatatcacaaaattatgtctttattcattttgtgcccccaaaacgtaaactaataattattttaaatgcattggtctcttaaatcatgtggaaaacaaaaagtagagttacaaaccattgttacaataatactagctttgccgggtgtggtggcttacgccaccaggtgatccacccacctaggttgcccagcctgggcaacaagagcacaactccatctcaaaaaaacaaaaacaaataaacaaaaaaccccaataataccagcttttttttttttttgagacagagcttcgctcttgttgcccaggctagagtgcaatggtgcggtcttggctcaccgcaacctccgcctcctgggttcaagcggttctcctgcctcagcttcccaagtagctgggattacaggtgcgcaccatcacagccggctaatttttgtatttttagtagagacggggttttaccatgttggtcaagctggtctcaaactcctgacctcaggtaatccacctgccttggcctcccaaagtgctgggattacaggcatgagccaccgtgcccggccaatcccagcactttgggaggctgaggctggcagaccacttgaggtcaggaggtcaagaccagcctggccaacatgctgaaaccgtgtctgtactaaaaatacaaaaattagctgggcacggtggcaaatgcctataatcccagttacttggggggctgaggcaggaggatcgttttgagcccgggatgtggaggctgtagtgagccgtgatcacaacactgtaccccagcctgggcgacagagcaagaccctgcctcaaaaaaaaaaaaaaaaaagcacaaagctttttgagaaatcactttcaaaaatggtacatttgtagttggggaaggttaatcgaacctaaaatataagaatcctggaccccaaaacctggagccagtattaccagcatgaatctaacccaagctcagtatacaagccacctgtagagctaaagagtgatttactaggccgggcacggtggcttacgcctgtaatcccagcactttgggagccgaggcgggtggatcacgaggtcaggagttcaagaccagcctggccaagatggtgaaaccccgtctctactaaaaatacaaaaaaaattagccgggcgtggtggcatgcgcctgtaatcccagctactccagaggctgaggcagagaattgcttaaacctggaggggcggaggttgcagtgagccgagatcgcgccactgcactccagctggggtgacagagtgagactccatctcaaaaaaaaaaaaaaagagtgatttactttctttgctttattaaattcttcagcactctgctattctgactcttctgttgttcgaagaaggtgatactttggaaagtagacagatttggcttttgagtattcaatccattaaacatttcaaaaatatgtcactgatattttgaaactcctgagagttcattgataaggaaagctgctggtgagaatcaatatttattttaaaaggcttttatcattctaattcttctaaaacctggtttcctaaatactgattataaaagctatcagaaggcgtggtggctcacgcctgtaatcccagcactttggggaggccgaggcgggtggatcacgaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccgggaggcggagcttgcagtgagcagagatcatgccactgcactccagcctgggcgacagagtgaggctccgtctcaagaaaaaaaaaaaatgctatcagaagataatggttacaagtaaagagggtctttcctcgagctacagtattttcagtgtactctggctttttttttttcctttgagacagagtctcgctctgtcacccaggctggagtgcagtggcacgatcttggcttactcctccgcctcctgggttcaaacaattctcctgcctcagcttcccgagtagctgggactacaggcacacgccaccacgcccggctcattttttgtattttaatagagacggggtttcaccgggttgcccaggctggtggtgaactcctgagctcaggcaatccgcccgcctcggcctcccaaagtgctgggatgacaggtgtgagccactgtgcccagccactctggctattttttttaaaaaaggagttaaatgagtttgcttctgcagatgaccattttctttctgcgtagctgtccttgttctccctcccagtgtgcgtgcaacacatgtacaggaggttcttgaccttagatataaattgtaaaattccacatatttgaactggtttatcccaacataaggtctcctttctgctttatttcagcctgcagatgtgccaatgtctttaggtcagtttcaagtttttgaaatgggaataagtgacactgaaggaagattttaataaatgaaacagttgtgtgacctaggaatataaccttgtgctcttagggaaggacattcttatcttttttttttttttcttaacggaagacctttatgataaacgctggagtacagacagtacacgcagctggcatgcagggtattgcatatacttaacatcttgagagtccttctgctttttcttcatcttctttttaatcctgatatgcaaaatgtattttgccattaaaacaattgtactattaaaacactgcagcatctggctgggcgtggtggctcacacctgtaatcccagcattttgggaggctgaggcgggtggatcacttgaggtcaggagttcaacagcagcctgtctaacatggtgaaaccccctctctactaaaaatacaaaaattagctgggtgtggtggcgggtgcctgtaatcccagctttttggaagactgaggcaggaggatcacctgggaggcagaggttgcagtgagccaagatcgtgccactgcactccagcctcggcgacaaagggagactccctctcaaaaacaaaaaaacaacaaaacactgcagcatctgaaatgatgcaaacaggattagggctatggactgtcttaatagtaatggtagtaatagcattaacaaccatagcagtaatatagaggaattaacttttattgaatagttaatatgtttaaggcaccctgtcatttagtcctcacaatcacccctattatcttcatttgacagatggagagactgaggctctgaaagattcatttacaaatccaaagtcatacagctagaaagtggtgaatttgcacccacatctgattctggagctggcactctaaaccagtgtgctgctccatctctccatagttgtacttctcatagaatcacaggatgttggtgcaggaaaggactgcttatatctgggtaccccacctttcatttccttcaagtcttgagatctttttgaactagaagcatgcatttagaagtgatattgatatcaccatctcctgttggtagatagatcattgagtggaaagaagagggttcaagggattctcccacctcagcctcatagtagccaccacgcccaactaatttttatattttcagtagagacggggtttcatcatgttggccaggctggtctcgaactcctgacctcaggtgatccactgccttggcctcccagagtgctgggattactcccagagtacatgagccaccgcaccaggccagggcaaaccctttcaagcaggagttccagtatactgagagatggaaatgcaattgatgtgaagtcctagcagtagcaaccagcagagctggccttcttccaggcttggagatcctctgccagatgctcatcttaccagatgcaggcagacctcttcatttcagaaaggtagacactgagggacagagagaccaaggccagcaggaagtcagtcactttagtaaagggtccaccagtctatcagtttcatgaatgtagagtctgtgcctgccttgtacacccctctatttgcagtgaccagaataagtagtaggactgtaaatttatgttataatgaattcattaccattatttaaagtggcatgttcatgcttttttttttttttttgagatggagtctcgctctgtcacccaggttggagtgcagtggtgtgatctcagctcactgcaacctccacctcctaggttcaagtgattctcttgcctcagcctcccgagtagctgagactacagacgtgccaccacacccagctaattttttgtatttttagtagagatgggattttgccatattgcccaggcttgtctcaaactcctggcctcaggtgatccattggcctcggcctctcaaagtgctgggattacaggcgtgagccaccgtgcccagaccctgtgctcttgatttcctatctttgtacttggcttttctctggccccactggtactattgttagaggtatctcatttggaggtgaaaggaggggaaataaatacagcagtcttgtcttttaaataaatacagcagtcttatgttactctactctgagatctgtctggccattgttggcaatttcatctgagcatcagcaattgctagtgacagccctacatctgggactcactttcctgtttggtataaatgtttctggagattagaataagggaagagaagtcgttttagcatttccgtatctcagttccaaagaggtttaaaaggcacgtgcaaatgacaaccccacaaaacaaaatcaactgagcaaaaatcaatgctctgcccaagagggaccatctttaagaagctttaagtgaagtttaccttgaaagttgtaattagaagcttcaggaagcaagtgcctttatggcagaatgactgatgttactcccaggatctcatggaattgtaaaattttatctctgttctgtgtaagtcaacctaaatcaaacagaaatattagtgtttgggtacatcaaaacacctttaacttgtcctttcattttggtttgccttttgacaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatggggccgggcacagtggctcatgcctataatcccagcactttgggaggccgaggcaggcagatcacctgaggtcaggagtttgataccagcctggccaacatggtgaaatcctgtctctaccaaaaatacaaaaaaaattagctgggcatggtggtgcacacctatagtctcagctactcgggaggctgaggcaggagaattgcttgaacccaggaagtagaggctgcagtgagtaagcatcacgccactgtactccagcctgggcaacagagcaagactctgtctcaaaagcaaaaaaaaaaaaaaaaaaagaaagaaagaaaaagaaaacaacaaatggcagagagccaccatattccaaatcactgaaaaaaataaatgaattatttttatttatttatttatttttttgagatggagtctcggtctgttgcccaggctgaagtgcagtggccccatctcaactcactgcaagctccacctcctgggttcacgccattctcctgcctcagactcccaagtagctgggactacaggcacctaccaccatgcccagctaattttttgtatttttagtagagacggggtttcaccatgttagccaggatggtcttgatctcctgacctcgtgatccgcccgcctcggcctcccaaagtgctgggattacaagcatgagccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataa

SEQ ID NO: 113 - DNA, 32446 bp, Homo sapiens
ctgggcggggcctcggcacaggagctggctgcgggagcccgccgtcctgagtcgcaggccgaggagacagtgagtgcgcgccctgagtcgcaggccgaggagacagtgagtgcgcgccctgagtcgcaggccgaggagacagtgagtgcgcgccctgggcgccccgccccagcccccagccccttccctgggcccccgcaaggcgggaacgcgagcgcctcccccgagctgtgtctcgagacctttgtcctcccctcacccctcggcccgctgcctgccctttactggccccctccctcatgcccgtccctcagcaccctctcctttcaactaactttcccgctcccgacagtggctgcacttcgtgacgctgagatacagaaggacgtgcaggtgagagctgtagggcctggaatggcccaagtggagcctaggctaatggaagtctggcctggcccgcaccctgtcccccgggactcctggagtcggggtagggcagggtctaggcttcgacctttccagggaactgaggtcggccaagtggaggtggaggtggtgacggagccctcgcgctgcagtcacagctcttctccctctctacccctcactccactgtgggacgctgggtcagacctactacgggcaggtgctgaagagatcggcagacctccagaccaacggctgtgtcaccacagccaggccggtccccaagcacatccgggaagccttgcaaaatgtacacgaagaagtagccctaaggtagagtgccctgtgctgtccccaggaagaccccaaacagcagttttcccaaaagataatgatgcaggtcactagggaattaacccgtagccaccaacccatcagcttgccttgtctattgtaaaaatcctaaatctcagcacccatcatcttactgctctaagaacctccgatgagtctgggcgcgccagtgagcctgtagtcccaagtgcttgggaggctgaggcagaggatcgcgtgagcccagaagttacaggctgtagtgtgcgatccgggatgtgaatagccactgcactccagcttggtcaacatagccagatgcatctctaaaataaatgcgtactttaaaaaaattgcctaaaaaaaagaacctccagcgtgaacactctgtagtccctacccatgctcacagaatacagtcacactcactggatctgccattcaagatatgcgcagttcagcacccactaatcaaccttggcccttttgacccttcccttcctcactccatcagcactgcctgcccagccggcagtcaccaatttggaaggtcttcccttttctttttccttcccaaccctgcgcatccagcaccacgctgctgtcccacctactgcatggagccttctctaatccttgagcggcctcttccccaaactgccacagcactctgtcactcggtctgtccgtaaatcacgggaagtgttttctgtgcacgatgttttatctcgcctctcaaatacacctacgcggcggggagcggtggctcacgtccgtcatcccagaacttgggaggccaaggcaggtagatcacttgaggtcagaagttcaagaccgacctggtcaacatagtgaaaccctgtctctactgaaaatacaaaaattagctgggtgtagtggggcacgcctgtagtcccagctacttgggaggctgagggaggagaatcacttgaacgtggaaggcggaggtcgcagtgagcggagattgtgccactgcactccagcctgggcaacagagaaaaactcagtcaaaacaaaacaaaacaaaaaaaaggccgggggtggtggcttatgtctgtaatcccagcactttgggaggccgaggcgggaggatcacgaggccaggagatcgagaccatcctggctatcatggtgaaaccccgtctctactaaaaatacaaaaatattatccgggtgtggcggcacgcgcctgtagttccggctgctggggaggctgaggcaggagaacggcgtgaacccgggaggcggagcttgcagtgagctgagttcgagccactgcactccagcctgggtgacagggcaagactccgtctcaaaaaaaaaaaaaaaaaaaaaaaaaaaaaaaattagccaggagtggtggcaggcgctcgtagtcctagctactcgggaggctgaggtaggagaatggtgtcaacccgggaggcggagcttgcggtgagctgagatcgcgccactgcactccagcctgggcgacagagcgagactccgtctcaaacaaaacaaaacaaaacaaaacaaaacaaatcaaaacaaaaaacgcctatgggacagaaaccttacattttttcctcaataactagcgcagtcctgggcctgaattagaagctcagctaatgattaaatgtatttattcaacacattattttattttatttatttatttttgagacggagtctcactctgtcccttaggctggagtgcagtggcgccatctctgctcactgcaacctctgcctcctgggttcaagccattctcctgcctcagcctcccgaggagctgggattacaggtacctgctaccgtgcccagctgattttttggtatttttagtagagacagggtttcactatgttggccaggctggtctccaactccttgcctcaagcgatccgcctgccttgacctcccaaagtgctgtgattataggcgtgagccaccgcgcccagcctgaacacattattttagatggcttatgaagtcttagtgcctagcacatgcccaacaatactgtggtaaagcagatacagtcccagccttcatgggtgtccagttcagtggagactaaacatcagaagtatgagtgaatgatgcaagaaagaaggaaggaaggaaggaacggagggagggagggaggagggaagtatgtataagatttagtggtttcatgtcttacagtctccagggaaaaaatatgtgttttccatttcccagatattatggctgtggtctggtgatccctgagcatctagaaaactgctggattttggatctgggtagtggaagtggcagagattgctatgtacttagccagctggttggtgaaaaaggacacgtgactggaatagacatgaccaaaggccaggtgaggcatgatttggaagacaaggagaaaaagattctcaaaagcattatttgaaaaataaagttgttttcttcgtggctcttcaaggataatttaagaaagcttctagttagcaatgctcatttgtgccactagtgcttcctgtcttggaaactgataacttgaacaattaggggttcttctgggcgaacacaagagtcggaggtttgctctgatatgaatatcgtgacgatagagtggactttgatctttcccttcttgctgccatctatcctgaaagattttgttattgaatgaggagtttattcaagccaaactgcacgggcagcagggagtttatgtcccaggttgtagtatatcctacgtgtccacaggaatcttgtatgtttatccaaaataatctaggggaagtatattctgttagtgataggaaatttttaggaaaaagttgtgtatttttttcaaaatgttatcaaaactatatttttcttactttaggtggaagtggctgaaaagtatcttgactatcacatggaaaaatatggcttccaggcatctaatgtgacttttattcatggctacattgagaagttgggagaggctggaatcaagaatgagagccatgatattgttgtgtaggtctatattcttactgttatgactatagcccattttctttattattattattattattattgagatggactctcgctctgtcacccaggccagagtgcagtggcccaatgtcagctcacgataacctctgcctcccgggttcaactgattctcttgcctcagcctctcaagtagctgggattataggcacacgctaccacatccagctaattttttaaatcttcttttagtagagacagggtttcaccatgttggccaggctggtctcaaactcctgatctcaggtgatccacccgcttccacctcccaaagtgctgggattacaggtgtgaggcactgtgctcagccctcatttccttttgaacacagagatgtcactattactgtttgctgaattgactctcatttagggtgttaaactaaacttagcatggcttactaatgggagagagctggtttgagctgctggagctcaccagcagcagaacacaccagaccaagagggaacttacttgaaacttaaccacaaaccaatgaacccaaaagaccagcaggaccactaagtttgctcctacaatacatgctgacctgtatctttcataatattttcatggtaaattataggattctatttccttttttccctcaagttgttattgtcaaatcatgcccaagtgacagctgcctttgaggaacatagcctgtttacgtgaagcataagaaatgccttgtgccggccaggtgcggtggctcacgcctataatcccagcattttgggaggccgaggcaggtggatcacgaggtcaggaattccagaccagcttgaacaacatggcgaaaccccgtctctactaaaaatacaaaaattagctgggtgtggtggcacatgcctgtaatcccagctatttaggaggctgaggcaggagaatcacttgaacccgggaggcggaggttgcaatgagccgagattgcgccattgtactccagcctgggcaacaggagtgaaacatcctctcgggaaaaaaaaaaaaagaaagaaatgccttgtgcagtaggcatctggtctgaggtttcatcttgttacatggtgaacatcaggacagaaacaagtaagaatcatgcctgatgttattttctgcacattcaaacttgctaacaatttattgagattttaagcactctgtctctgatcttggggaaaagcttagttgaaggcattagaaagagaggagggaggcggtaagaatggggtagctttgacagaacggtgggaaccacctttagggtctgaaaggatttgcagatctctgagtgttgtgaagatttgctcgacatttcatctgttctcttttagatcaaactgtgttattaaccttgtgcctgataaacaacaagtgcttcaggaggcatatcgggtgctgaaggtgaggaggagagtgagataaattatctttgaacatcagtaagagctgatgggttaagtcttgtttgttcccccttgaactaagagctcaaactctcttaatttatccattaaatgaataaggggtggcaaaagggggaaggggcaggaataccccggatatggattactttccctcttaggttgcaaaaggtagtaaatccgaggtgacagttgtcactgaatgtgttaaggtatttgctttcttgactgtctctcctatttgctgctgtacatgatcctagaagagcatctgtggagctataggaatctttgcactgactactaatgattgctttgaatatactctcttctagcatgtacagtgtttctcagggcttctgatttcttatctgtcatgatttcagatctttgggaagttacagaagatggaacttttacattaactacttgctaaaaggaaagcttgcaggagctccacagccttcattgtatcatgagatgtgtatcttcatgatagtagatgaaatattcagccaggtgcggtagctcacacctgtaatcccagtgctgtgggaggccgaggcgggcagatcacctgaggtcaggagtttgagaccagcttggccaacatggagaaactctgtctctactaaaaatacaaaaattagctgggtgtggtggtgcgtgcctgtaatcccagctcctcgggaggctgaggtaggagaatagcttgaacccagaagtcagaggttgcagtgagccaggatcgtgccactgcactccagcctgggagacagagcgagactccatctcaaaaaaaaaaaaaaaaaaaaaagattctagctgggtgggtggtacatgcctgtactcccagctacttggatgctgaggcaagaggattgcttgagctctggagtttgtgtgcagcttgggcaatatagtgtgatcactgcctctaaaaaaatgtttttttttttgagatggagtctcactctgctgtccaggctgtagtgcagtggcaggatttcatctcactgcaacctccgcctcctgggttcaaacaattcttttgcctcagcctccctagtagctgggactacaggcgtgtgccaccatgcccagctaatttttgtacttttagtagagacaagatttcaccatattggtcaggctgatcttgaactcctgatctcatgatctgcctcagcctcccaaagtgctgggattacaggcatgagccgctgtgcctggccaaaatttttttttaaattgacaacagatttttgagatttttggtttacaaagctgtcatagaactcaaatacaaatatctatatagaaatgatttaatgatttagtgatgtctttgttagtatgtcattttacacgccagttcactatctccaccaaaaatgtacttataaaaggtagaaacactattatagaatctagatctccaggtttccaggtttttgaaattagctaaataaaatgttaagttcctgatcactcatttgccttacattttaaggataatattttaaagataaaatgtgttgttataaaagtaaataacaacattacaaaaagttatattttttaatagaaatggggtcttgctgtcacccaggctggaatgcagtgtcactatctgtacccctctaactcctgagttagaggggtccagatagtgacactcactgtaccctctaactcctgggctcaaacaatcctcttgagtagctaggactccaggcacatgccaccatgcccagctagtttttaaatttctatatgggagagagggtcttgctgtgttgccaaggctagtctcaaactgctctcctccagcaagcctcccacttcggcctcctgagtcattgggattagaggcctgagccatcatacctggcaaagttatactattcttaagagataaaagattatgaatactgatgatatcctctgttctacaatgacctggggctgcttttggttcagattggctaaaaatttaaatgtaagtaacctgaaaatctttatttaggagacagacactcttagaatgtgattttattacctgttggataagccactgggaggaaaaaaaaccttggcacttgactattgattgtaactaaagaggcagctgctatttgttcacaaagggtcagcttaaacattgctattgatttttaaatttgattttgttcccctattcctttctttgttatgtggggtcaatgtaatcattaatcatcttgtttggactaatatgcctctgtttcagcatggtggggagttatatttcagtgacgtctatacgagccttgaactgccagaagaaatcaggacacacaaagttttatggggtaggtgattttgtttagtttagtattaaggcagatggttgtacatgtgcagaactcctttctgctaatagccaggatgaggctatatgagatcacatggggttaggccatgaggccaaggttccattcttcctctgccattcaaaagtgatagggctttggatagtttaattcatctctttgagttatcgttttccaaattgtaaaatgtaaataataatacaatctgccttatagggctgttatgaagattaaatgggataaagaatgggaaaaatactttgaaaactctagtgtggaaatgaggacaattgttcccaagctggtgtcctcttagtccccttatgttctcatcattattgtgttctttattcctttattatcattttaatagtctggaagttgagataaatgcatgcttttcatcagtctatgaaatcaaaagttcttattcttaaaataatattaactttattcttactatgtaataataaataggtaccgttaacaagttggaaagtgccaaaaaaaaaaaaaaaaaagaaaaaattactaagctggacacagtggcacacacctgtaaccccagatatttgggaggctgagtcaggaggattgcttgagcctaggagttcaggtacagcctgggtgtcatagtaaaaccctatctcttaaaaaaattacttataatcatataacccagtgataacttcttttttttttttttttttttttgagatggagtctcgctctgtcacccaggctagagtgcagtggcgcaatcttggctcactgcaacctccacttcccgggttcaagtgattctcctgcctcagcctcccaagtagctgggattacaggtgcatgccaccatgcccagctaatttttgtatttttagtagagatggggtttcactgtgttggccaggctggtctccaacacctgacctcatgatctgcccacctcggcctcccaaagtgctgggattacaggcatgagccaccgcgctcggcctatgatttattttttatactactttattcacataacagtgcttttcagaatgtggcgtactgcatacatgaatattatgcttgcagctgagtagaaccaatccaccagtgagtgtcctgaagaatggttcctagagaccatcagctagcacacccagtcttaaccatggctttctagaccttggagggatgctcaagttagcttctactgctaggatctatgttttaactaataccatgtcctaattaattatatagaagaatagttcccttaatactgtattaagtgttggctggtctgtggttttttgttgttgtttgttttttaggtgagtgtctgggtggtgctttatactggaaggaacttgctgtccttgctcaaaaaattgggttctgccctccacgtttggtcactgccaatctcattacaattcaaaacaaggaactggaaagagttatcggtaagatatgacagacagcagggactattataactacagcttgaatgattgaaatgtggtgattagtaagtaacttctgaaggagtctcattgagggatactttctgttatctggaaatagctatcttgcctcctgtacaatggtaaccccccaaaaattttgatatttaataaagcactttgaagtcattcagtaaatagagtgaagtgctcagaaagataactgatgacatgcaaggaagaaaatcatctttataacgtgtttgctccttgtctgctgagcaaggcaacaactgggggagtgctggagatgaaccgtgaataaattctatttttaggtgactgtcgttttgtttctgcaacatttcgcctcttcaaacactctaagacaggaccaaccaagagatgccaagttatttacaatggaggaattacaggacatgaaaaagaactaatgtttgatgccaattttacatttaaggtaaataaaacaatttccatgacttctggtattctttctgctcttgcccttgctccagctatcttttcttgactttgcattgcctcccatttttctggtgttggtttgtttgtgtgtgtgtttaaatgtatgtgtgtgtttcaagtggagtaaaaaagcattttttccccaatacttatttatttattgacagggtctcgctctgtcacccaggctggagtgcagtagcacaatcatagttcactgcagcctgacctcctgggctcaagcgatcctcccacctcaggcttctgagtagctaggactacagactcatcaccacacctggctaatatttgtattttttgtagagatggggttttgccatgttgcccagactggtcttgaactcctgggctcaagtgatgtgcccacctcagcctcccaaagtgctgggattacaggcgtgaaccaccgtgcccagccctcaatatttattataaaaatgtttttggccaggtgcggtggctcacacctgtaatcctagcactttgggaggctgaggcaggcagattacctgaggtcaggagttcgagaccagcctgacgaacatggcgaaaacccatctctactaataaaaatacaaaaattagccgggcgtggtggtgggtgcctgtaatcccaactactctggaggctgaggcaggagaattgcatgaacccgggaggtggaggttgaggtgagctgagatcatgccattgcactccagcctgggcaacagagtgagactccatctcaaaaaaaaaaaaaaaaaaagaagtttttgaatacagaaaagttaatagtacaatgaatacccacataggcattacctatatttcagcaattgagaacatttttccatgtttgtgtgtttatatgtgtatatatatatatatatttatttgctgagccattgaaaataagttgcagatattatgacattttacccttaaatatttcagcatgcgtcccataggaatgtaatatccctctgcataatcacaataccattacacacctaagaaaactttttacaagaagcctcattcagacattggattaatagggctatagagaagtaggatggaaaagagtaggagtatgtacaatagtatttcaattgtttaattgtgtcaaggaattaagaaattttaatgttggatgatggcactaattggcatttttactgccctgtgcatagtaagatttgttttctcaaaatggaaaagttcaggctttggaatcagatacctgggttcaaattctggctctattattattgttttttatttttttttctgaatgtcactagacaaacttttattgaagcataaattgtggtacagaaatacattttaactgatttaagtccaacaccagtgaaaggagagattatggcaccaaaactttccctttcctatcataccatgatttagattatgatgcaatctacatttctcttttctaggctttgtcccatacaaatttgggcagtttttcaacattagaatttcaacattagaattcttaattctattaggaaaaaaagcaacaaaaaaaccagacctcaagtcaacaaatctattggatattgtttatgaacgaagtccacgttaagcattggtcctcaaaacagagctcctcaaaatattaggtgctgtgctcattacagaatcaaactgatcacactgattgaaaacttcctcaatgaaattttcaatcaacaacatgcttcaaataaaagtcaaacagtgttccaaccacttgacttcaaaccaagtagattttaggtttagaaacactaaaaaaaggtgtttcatttataaatacagaaggaacaaaaacatcactgcatcaatccagaaattatcaaaatatttagaggacaagaaatataaaatttagtcaactttgctgctttctcagttccttaaaatcccagagtatctgcaaatatagctaaaaagtaccaactcttgaaagcctatattactagtcatttcccattgagtattttggaattttatttatgttctacttatttattcatgtattctgctttatgatgtttatctgaataatctggacaaattctcattctgggcagtcattcgtttcatcctatgaatgccatggtgagggaaacagtgtagttagaggaacagatgaagtcagaacactcacatgcatcacggtcacagaactttaagtcacaagacagaaaagaaatcgattctgctttggatcaaagtttatagaacactacttaatggaaactagtggaaatggctgctaaaggaaaagttaaggtgaatgatccaagctgacttgattactgaatccagaacaaaattatgctaaatctctctggtaattaactaaataaaaatcattttatactattatttagtaagttagtaaaggcgtgctactcattagatgctaatctcatttactgaggaacacagaattgtatatgttttctggctctattatttattacttgggtaaacttgaacaagtcaccaaaattcgttgggttacagtttgttctactgtaaaagcagggataataatacttactttgcagaatttctataaggattagcaataatgtagcaaaacactgggtacatactgcaagttcagtgaaaagaagatactgtcattatttgttccaaaagtggaagaacttactattaatatttcatttttctgatttatttatttatctattttagagacaaagtctctctctgtcacccatgctggagtgtagtggcacagtcatagctcactgtaacctcaaactcctgggctcaagcgattctcccatctcagcctcccaagtagctgggactacaggcatgtgtcaccatgcctggctaattttttatttttatttttttgttggtgagacaggttttttttttttttcttttttgagaccaagtctcgctctgtcactcaggctggagtgcagtggcccgatctcggctcactgcaagctccacctcccgggttcacgccattctcctgccttagcctcccaagtagctgggactacaggtgcccgccaccacacccggctaattttttgtatttttagtagagttgggatttcaccgtgttagccaggatggtctcaatctcctggcctcgtgatccacccgcctcggcctcccaaagtgctgggattacaggcgtgagccaccactcccggccaagacaggttcttatattgcccaggctggtcttgaactcctggcctcaagcaattctcccacctcagcctcccaaagttgcaagcatgtgtcactgtgcctggcttcttctgatttttttggtctaaatagcatctccagatttcttttttttttttaatttaaaaaatgtatttatttctttatttagacacagggtcttgctatgttgcccacactggggtacactggctattcacaggtgtaagcatagcccactatagtcttgaactcctggcctcaagggatccttccacctcagccttccaagtctgggactacatctggctaagcatcttcaaatttcttatttatttatttatttatttttgagatggagtcttgctctgttgcctaggctggagtgcagtgactcaatctcagctcactgcaacctctgcctcctgggttcaagccgattctcctgccttagcctctcgagtagcagggattacaggcgtgtgccaccacacccagctaatttttatatttttattagagacagggtttcaccatgttggccaggctggtctcgaactcctgacctcaggtaatctacccgcctcggcctcccaaagtgctgggattacaggcgtgagccactgtgcccggctgcatcttcaaatttcttaaatactccttggtatagtggagcccttaatgcttttcactaatgcactgctccttgatgtgctgcctattccagtagatacacagaatcagagtggtaagggcctttgaaaccattgatttgttctagtggctttcaaaaaccatttttaatacaattattttttaagcaaaatgttttatatatatatatatatggtttttttttttttgagatggagtcttgctctgttgcccaggctagagtgcagtggtgcaatctcggctcactgcaacctcagcctccctggttcaagtgattttcctgcctcagcctccccagtagcttggactacaggtgggtgccaacgcacctggctaatttttgcatttttagtagagacagggtttcaccatgttggccaggctggtcttaaactcctgacctcaggtgatctgcccacctcggcctcccaaagtactaggattatagatgtgagccactgtgcccagccagaaatgcactttaaaaaccaccagtccttgcctgggcatggtggctcacacctgtaatcccagcactttgggaggctgaggcgggtggattacctgaggtcaggagttcgagaccagcctgatcaacatgatgaaaccctgtctctactaaaaatacaaaaattagccgggcgtggtggcgtgtgcctgttatcccagctactcgagaggctaaggcaggagaatcggcttgaacccaggaggcagaggttgcagtgagctgagattgagtcactgcactccagcctgggcaacagagcaagacttcatctcaaaaacaaacaaacaaagaaaaaacccccaatagtccaaagccctaattttccccccattatttatttttttaatgggcaaattttaaaaattgtatatatatttatggtgtacaatgggatgttttgacatatgtatacattatggaatgactaaatcaagataattaaaatgcattacctcacatactcaccatttatttgtgatgagatcaaagtctactcttttagcaattttcttttttcttttcttttctttctttatttcttttttttttttttttgaggcagaatcttgctctgtcgcccaggctggagtgcagtggcacaatctcggctcactgcaacctccacctctcaggttcaagcgattatcctgcctcagccttccaagtagctgggactataggtgtgtgctaccacacccagctaattttttgtatttttagtagagatggagtttcaccatgttggccaggctggtcttgaactcctgacctcaggtgatccccctgcttcagcctcccaaagtgctgggattacaggcgcgaggtgcccagccttttagcaatttccaatacattgttattaactatagtcaccatgttgtataatagatctctttaacttattcctgataactgaaattttgtatcctttaaccaacatctatcctgttccacccctgccctcccaccccctacccccagcccctggtaagagcctctactcttcacctctatgagttcaactttttgaaattccacatataatctagcgaggttatgcagtatttgtttttcagtgcctgcagatatgacatttttgggttcaactttttgtttgtttttgagatggaatctcactcttgtcgcccaggctggagtgcagtggcgtgatcttggctcactgcaatctccgcctcctgggttcaagccattctcctgtctcagcctcctgagtagcagggattacaggcgcctgccaccgtgcccagctaatttttgtatttttagtagagacggggtttcactatgttggccaggctggtctctaactcctgacctcagacgatctgcctgcattggcctccaaaactgctgggattacaggcatgagacactgcgaccggccaaacatttttttaatgcataatagatgtacatactttcagggcacatctgataatttaatatattcatataatttgtacagatcaagtcaatgtaactggtatatccatcgccttaaacatttgtcttttctttattctaggaacccatttgaattattcttttctagctattttgaaatatacaatagattattgtgaactatagtcaccctactgatccatcgaacactaggtcttatttcttcttattaaactggattttgtactcattaatcaagctctcttcatcctccccactctacctggcgtctggtaaccaccaatctactctctattatcatgaggtccacttttttagctcccacatatcagcgagaacatgtaatattcgtctttttgaggttggcttatttctcttaacataatgacctgcagttccatgcatgttgctgcaggtgacaggatttccttcttttattttattttattttatttttttgagacagagtcttactctgtctcccaggttggagtgcagtggcgtgatcttggctcactgaaacctccggctgccaggttcaagtaattctcctgcctcagcctcctgagtagctgggactacaggcgcgtgccaccacacccaactaattttttttttttttttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccactaatttttgtatttttagtagagatggggtttcacatgttggcaaggctggtctcgaactcctgacctcaggtgatccgcctgcctcggcctcccaaagtgctgggattacaggcttgggccaccgcaccaggccaggatttccttctttttcaagtctgaatagtattccagtgtgtacatatactactacgttttctttatccgttcatctgtttgagtcttctttttttcttagtttagctaaagatttattttattttttcaaaaaactaatttttcattttgttgatcttctgtatttttttagtctcaatttcatttatttctgctgtgatgttctttctttccttctactaattttgagtttgatttgttcttgcttttatagttccctcatgggcattactaggttgtttatttgaagtctgttccttctttccttcattccttccttcctccctccctccctccctcccttcttccttccttccattctttcttttttttttgagagggaatctcgctctgttgcccaggttggagtgcagtggcgcgatctcagctcactgcaacctccacctcccgggttcaagcaattctcctgtctcagcctcccaagtagctgggattacaggcatgcaccaccacgcctggctaatttttttgtatttttagtagagacggggtttcaccatattggccaggctggtcttgaactcctgactctgcccgcctcagcctcccaaagttctgggattacaggtgttagccattgtgcccggcccttctttcctttcttcttctttctttctcagggtctcactctgtcacctggactggagtgcagtggtgcaatcatggctcacagcagctttgacctcctgggctcaggcaatcctcctaccccagcatcccaagtagctgggactaaggctaccatgcctggctgatttttgtattttctgtagagacaggctttcaccatgttgcccagtctgctcttgaactcctgggctcaagcaatccacctgccttggcctcccaaagtgctgagatcttatttgaaatctttcaacttttttgatataggcattacttgaaatctttctacttttttgatataggcatttattgctataaactttcctcttagtgctgcttctgctgtatcccatagatttttgcatgttgtatttccattttcatctgtttcaagatattttaaatttttctcctaatttcttcatggacccattggctattcaggagcatgttgtttaatttccatgtgtttgtgtattttccaaggttcttgttattgatttctaattttattccatagtggtgagaaagatacttgttatgatgtctacttttctgaatttgttaagacttgttttgtggcctaagatatagtctatgctggagaatgttccatgtgctattgagcagaatgtctattctgcagcagttgagtaaaatgctctgtgaatgtcagctaggcctatttgagctagtatatagtttaatgtttctttattattttctgtctggatgatctgttttactgagagtgaggtgtggtgttagagtcccctactactattgcattacagtatatctcttcttttagatctattaatgtttgctttatatactttggagctccaatgttgagtgcaaagatacttatatcttcttgctgaattgacccctttatcattatatagtaaccttctttgcctctttgacagccttgattcacagtctgttttatctgatgtaagtatagctactcctgttcttttttggtttccagttgcttggaatgtcttttttccaccccttaacttccagtatttttataagtaaagtaggtttcttgtaggcagcatataatttggtcccatttttgtatccattcagccactctattccttttttttggggggggttcccaagttttattcaagaactcataccaaatattccagataaataaatttttatcttcaccttcctcctcttctttttccaggttaatctggaattaacgtcattcataataactctttttgctgttagcaactacacacaacaaatcacatagattattcttcaaatattttttggtgagatatttcaaataccttttggaaaaaggtacctcagaagtcacagtgatcttgctgttgctcctttcgatggttataatgctccaccaagattcccagcttttccattcactttaatcctctcttgcaaaaactgctcaaaattggcagcatctatgattccattttctacaaggtgggtacagtcaagagtgaacatcataacctgcttctttttttgcctctctttgccacaagctttttcacagcactatgcctcttaattggagaattgagtccatttacatttagtgttattattgatacataaagacttaacatttttttaaattgatacataattgatgtagctattttggggcgttcatgtgataatttaatacattcatataatttgtaaagattaaattagtgtaattgggatacctatcaccttcaatatttgtcttttcttttctttttttttctgtgagatggagttttgctttttttgcccaggctggagtgcaatggcgcaatctcggctcactgcaacctccacctcccgggttcaagcaattctcctgcctcagcctcccgagtagctgggattacaggcatgcaccaccatgctcagctaattttgtatttttagtagagacggggttttaccatgttggtcaggctggtctcgaactcctgacctcaggtgatccactcgccctggcctaccaaagtgctgggattataggcatgagccaccacacctggccctgtcttttctttatgttggaaacattcaaattattctcttctagctattttgaaatatacaatatattattgtaaactagtcactttactgatatatcaaacactaggtcttatttctttcatcaaaccctatatatatatatatatatatatatatatatttttttttttttttttgagacggagtctcgctctgtctcgctctgtcgcccaggctagagtgcagtggcacaatctcggcccactgcaagctccgcctcccgggttcatgccattctcctgcctcagcgccccgagtagctgggactacaggtgcctgccaccatgcccggctaattttttgtatttttagtagagacggggttttaccatgttagccaggatggtctcaatctcctgaccttgtgatccacccacctcggcctcccaaagtgctgggattacaggcttgagccaccgtgcccggccaaaccctatatttataaccattaatcaacttctctttatctcccccattctgtaccctttctggcctttggtaactatcaatatactctctatcttaatgagttccactttttttagcttccacatatcagtgagaacatatgatatttgtctttctgtgtttgccttatttctcttaacatgacctgcagttccatgcatcttgctgcaaatgacaggatttccttctgttttaaaatctgaatagtattccattgtgtatatatgccacgttttcctcatccattcatccattgctggatgcttaggttgattccatatcttggttattgtgattaatgctgcagtcaacattaggagtgcagatatttccctgacatactgatttcatttcattcccttcccttcccctgcctgtctgcctgccttccttccttccttccttccttccttcctttcttccttccttccttcccttcctccctccaccccccccgcccctttcagatggaatctggctctgtcgcccaggctggagtgcagtggcgcaatctcagctcactacaacctccgcctcctgggttcaagcaattcttctgcctcagcctcccgagtagctgggattacgggcatgtgccgccatacccagctaatttttttgtatttttagtagaggcagggttttaccatattggccaggctggtctcgaactcctgacctcatgatccacctgcctcagcctcccaaagtgctgggattacataggtgtgagccaccgtacacagccagtttcattttcttttcttttttttttttttttgagacggagtctcgctctgttgcccaggctggagtgctggagtgcagtggcacgatctcggctcactgcaagctccacctcccgggttcacaccattctcctgcctcagcctcccaagtagctgggacaacaggcgcctgccactatgtccggctaattttttgtatttttttagtagagatggggtttcactgtgttagccaggatggtctcgatctcctgaccttgtgatcggcccacctcggcctcccagagtgctgggattacaggtgtgagccaccgcgcctggcccattttctttagatatatacccaagtagggggattgctgggtcatatagtagttctatttttaattttttgaggaatctccatactgtttcccataatggctgtactaatttaaattcccaccaacagtgtgtaaggattagtgctggtgaggatgtggagaaaacgatacttctgggcattttttcttctattgagactaaagttgcaactcttagtatttttttttatactaccctttaggaaggtgaaattgttgaagtggatgaagaaacagcagctatcttgaagaattcaagatttgctcaagattttctgatcagaccaattggagagaagttgccaacatctggaggctgttctgctttggagttaaaggttagtttggctttcactacctgagagaactattttatttatttatttttgagatggagtctctctctgtcacccagactggagtgcagtggtgtgatcttggctcactgcaacctccgcctcctgggttcaagcaattctccctgcctcagcctcccgattagctaagattacaggcacccaccaccacgcccggctaatttttgtgttttttagtagagatggggtttcgccatgttggccaggctggtcttgaactcctgacctcaggtaacccacctgcctcagtctcccaaagtgctgggattacaggcgtgagccactgtgcccggccagtatgcatggtctcttgaggcgcacttctcttgctggtcaaatgttgttagacggttatataccagttaaacgccaccattttgcctcttaatgtgcatgcttgagcccacttgcccaactcccgagatcttatcgggaagctgctgatcaccagtttcaggtgtttctgtttattgggagacttcctttccctggtactgtctgtgactaattatgattttcgagagacagttaacaaccacctgatcatcacctaatgatcgcctgacattcctggtggagtcggcgcggggagccctctcctgccctgctcacgcctgactagctattatacctgctttaacaagttctccaaaattcagagacctttcgtgagtattctgattttataataaaatagttatttgcataagtttagtaagagtcttttctctcaaaacaggacaattggagacacttggttattttaccaaagctttgactggaataacatttgtaggtaaagttccagcaaagccaacttgaaaagagcctatctggccaaactcttgctggacttcatgcaaatgatcaggcaaagtttaataagcctaaaatttattttgcacataaattggccttactataatttgtctttagtataaaaggaggagctgggtgcagaagttcacactcataatcccagcactttgggaggctgagacaggcagatcacttgaggccaggagtttgacaccagcctgggtaacatgttgaaaccctgtctctaccaaaaatacaaaaaaattatctgggtatggtggtgcatgctggtagttccagttactcaagaggctgagatgggaggattgcttgagcccagggaggtggagggcaatgagccaagactgcaccactgcactccagcctgggcaacagagtgagactctgtctcaaaaaaaaaaaaaaaaaaaaaaaaaagaaagaaggctagagagagaaatggtttcaaaggaaaactataacacttgttactagatttccagcctggacttttgtttttgagtgcatattgaatcattaattatttcttggctacaataaccctctaaagataaaccaggttataatttttcttcatgtttttagtttgtgccctaagtggaataggttccttattctgttctgacacacgaatactcttttgactgtcatattattaatgttatttatagctccttgttttacttccaaagaaaccagaatcatgatattctaaggttagagaatcccccgtttggaatcccactggtcctaatctgcttttcactgcaaattccgtgctgctaaaattatataagcactcttctctaggcccagggacctatcacacaaaaggtaggtgtgtgagactgtaagggccagttttgagagaattatttcagactctccaaatcaaaaatgggcacacagatgcataaacagctggtaaaataagggactctgcctcctgggttattatgtgtgtggcaccttttcatccatcccaatcataaagaatttcctgcttctcgtagaatgaaaagaaaattattactgagaggatataaaggtacctcatgtcaaagcctcctaggtttaatactctgagttatgagatttatgcagataacatatatattttttaaaattttagaacaggccaggcacagtggctcaagcctgtaatcctagcactttgggaggccaaggtgggcagattgcctgagctcaggagttcaagaccagcctgggcaacatggtgacaccccatctctactaaaatacaaaaaataaattagatgggcatggtggcgtgcgcctgtagtcccagctacttgggaggctgaggcaggagaattgcttgagcccgggaggcggaggttgcaatgagacgagattgagatggcgccactgcactccagcctggcaacagagtgagactctgtctcaaaataaataaataaataaataaataaataaataaataaataaataattttagaacaaattactgaaagaccacaaaaaaaaaaactgtagcacaacggaagtctctaaattccttagcttaaaaggttttaacagtgcttatgttttgtatagctaattgctgtaagtctgtaactaaaaccaagattacagtagcacaatgcatagaagttaaagataagtcaattttttaacctcacctttggctttttgtttgttggcttttatattaagaaattttaagggtttattaatgcctatccacatccattcccatctggcctagaactttcttttttttggtgggggagggggacggagtcttcctctgtcacccaggctggggtgcagtggcgtgatctcatctcactgcaacctccgcctcacaggttcaagtgattctcctgcctcagcctcctgagtagctgtaattacaggcatgtgccaccatgcctggctaatttttttttcttttttttttttttttccgagatggagtcttgctctgttgcccaggctggagtgcagtggtgcgacctcggctcactgcaacctctgcctcccaagttcaagcgattcttctgcctcagcctccagagtagatgggactacaggtgcgtgccaccatgcctggctaatttttattttatttttttagtagagatggggtttcatcatattggccaggctggtctcgaactccttacctcatgatccacccaccttggcctcccaaagtgctgggattataggcatgagccactgtgcccagccctaattcgtatttttagtagagacagggtttcaccatgttggtcaggctggtctcaaactgctgatcttaggtgaccaacctgtctcggcctcccaaagtgctgagattacaggggtgaaccaccatgcctggtctggcctagaactttcaaattcgctatgtgtcttttggctctaagccccttgaccataggggtcccaccaaggcacaagatggacccagggaaggcagctgtgccaccccagcaacacagtgagataaaataaaagtttggtgaccattgatgttgcctctgacaaatctaggccagaatgcggagaaagtaaatcaaaaataaaattctaggccgggcgcggtggctcacacctgtaatcccagcactttgggaggccgaggcgggtggatcacaaggtcaggagttcgagaccagcctggccaacatagtgaaaccccgtctctactaaaaataaaaaatcagccaggcgtgggggcaggcacctgtagtcccagctacttgggaggctgaggcaggagaattccttgaacctgggaggtggaggttgcagtgagccgagatcatgccactgcactctaacctgggcgacagagcgagactccatctcaaaaaataaaaaaaaataaaaaaataaaaaaataaaataaaattataaaccctcaaccatctgaacggacccctcctgtcgggcaaaggcattgcaaagttatcctaaaaaactagttcaggtcacgaagggaaggagaagtttggacatgcctcattattccctcctcccttttggaattcagacactgctgaccagcattaccattaaaacagatcttaagactgatagaacagactctttaaatctggtaagaaacatttacaatctattctctctgtagcctgctgcctagaggcttcatctgcatgataaaaccttggtctccacaatctcttatcataacctagacactcccttctattgatcccaggtctttggattataactcaaccaattgccaatcacaaaatctttgaatctgcctgtgacctggaaatccccacttccagttgtcccacgtttctggtctgaaccaatgtacatattatatgtattgattgatgtcttatgtctctctaaaatgtataaaaccaagttatagggtgaccactttgggcacatgtttgcagatctcctgagggctgtgtcacaggccattggtcacttatttggctcagaataaatctttttaagtattttagagtttgaccctttttgttgacaatgtttaacatcctacagttatgacaccctaatttgaatttatacagcttaacttcaataacatactaaaattctgctcctttaaagcttgttctcaactattttagttcttttttttttttttccattgacagagtttcactctatcacccaggctggagtgcagtggcacgatcttggctcactgcagcctctgcctcctgggttcaagtgattctcctgccccagcctcacaagtagctgggattacaggtgcgccagccaccatgcctggctaattttttgtatttttagtagaggcggggtctcatcatgttggccagcctggtctcgaactcctgacatcagatgatccaccagcctcggcctcccaaagtgctgggattacaggtgtgaactaccacgcccgggtctttctagttcttgatatcacaaaattatgtctttattcattttgtgcccccaaaacgtaaactaataattattttaaatgcattggtctcttaaatcatgtggaaaacaaaaagtagagttacaaaccattgttacaataatactagctttgccgggtgtggtggcttacgccaccaggtgatccacccacctaggttgcccagcctgggcaacaagagcacaactccatctcaaaaaaacaaaaacaaataaacaaaaaaccccaataataccagcttttttttttttttgagacagagcttcgctcttgttgcccaggctagagtgcaatggtgcggtcttggctcaccgcaacctccgcctcctgggttcaagcggttctcctgcctcagcttcccaagtagctgggattacaggtgcgcaccatcacagccggctaatttttgtatttttagtagagacggggttttaccatgttggtcaagctggtctcaaactcctgacctcaggtaatccacctgccttggcctcccaaagtgctgggattacaggcatgagccaccgtgcccggccaatcccagcactttgggaggctgaggctggcagaccacttgaggtcaggaggtcaagaccagcctggccaacatgctgaaaccgtgtctgtactaaaaatacaaaaattagctgggcacggtggcaaatgcctataatcccagttacttggggggctgaggcaggaggatcgttttgagcccgggatgtggaggctgtagtgagccgtgatcacaacactgtaccccagcctgggcgacagagcaagaccctgcctcaaaaaaaaaaaaaaaaaagcacaaagctttttgagaaatcactttcaaaaatggtacatttgtagttggggaaggttaatcgaacctaaaatataagaatcctggaccccaaaacctggagccagtattaccagcatgaatctaacccaagctcagtatacaagccacctgtagagctaaagagtgatttactaggccgggcacggtggcttacgcctgtaatcccagcactttgggagccgaggcgggtggatcacgaggtcaggagttcaagaccagcctggccaagatggtgaaaccccgtctctactaaaaatacaaaaaaaattagccgggcgtggtggcatgcgcctgtaatcccagctactccagaggctgaggcagagaattgcttaaacctggaggggcggaggttgcagtgagccgagatcgcgccactgcactccagctggggtgacagagtgagactccatctcaaaaaaaaaaaaaaagagtgatttactttctttgctttattaaattcttcagcactctgctattctgactcttctgttgttcgaagaaggtgatactttggaaagtagacagatttggcttttgagtattcaatccattaaacatttcaaaaatatgtcactgatattttgaaactcctgagagttcattgataaggaaagctgctggtgagaatcaatatttattttaaaaggcttttatcattctaattcttctaaaacctggtttcctaaatactgattataaaagctatcagaaggcgtggtggctcacgcctgtaatcccagcactttggggaggccgaggcgggtggatcacgaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccgggaggcggagcttgcagtgagcagagatcatgccactgcactccagcctgggcgacagagtgaggctccgtctcaagaaaaaaaaaaaatgctatcagaagataatggttacaagtaaagagggtctttcctcgagctacagtattttcagtgtactctggctttttttttttcctttgagacagagtctcgctctgtcacccaggctggagtgcagtggcacgatcttggcttactcctccgcctcctgggttcaaacaattctcctgcctcagcttcccgagtagctgggactacaggcacacgccaccacgcccggctcattttttgtattttaatagagacggggtttcaccgggttgcccaggctggtggtgaactcctgagctcaggcaatccgcccgcctcggcctcccaaagtgctgggatgacaggtgtgagccactgtgcccagccactctggctattttttttaaaaaaggagttaaatgagtttgcttctgcagatgaccattttctttctgcgtagctgtccttgttctccctcccagtgtgcgtgcaacacatgtacaggaggttcttgaccttagatataaattgtaaaattccacatatttgaactggtttatcccaacataaggtctcctttctgctttatttcagcctgcagatgtgccaatgtctttaggtcagtttcaagtttttgaaatgggaataagtgacactgaaggaagattttaataaatgaaacagttgtgtgacctaggaatataaccttgtgctcttagggaaggacattcttatcttttttttttttttcttaacggaagacctttatgataaacgctggagtacagacagtacacgcagctggcatgcagggtattgcatatacttaacatcttgagagtccttctgctttttcttcatcttctttttaatcctgatatgcaaaatgtattttgccattaaaacaattgtactattaaaacactgcagcatctggctgggcgtggtggctcacacctgtaatcccagcattttgggaggctgaggcgggtggatcacttgaggtcaggagttcaacagcagcctgtctaacatggtgaaaccccctctctactaaaaatacaaaaattagctgggtgtggtggcgggtgcctgtaatcccagctttttggaagactgaggcaggaggatcacctgggaggcagaggttgcagtgagccaagatcgtgccactgcactccagcctcggcgacaaagggagactccctctcaaaaacaaaaaaacaacaaaacactgcagcatctgaaatgatgcaaacaggattagggctatggactgtcttaatagtaatggtagtaatagcattaacaaccatagcagtaatatagaggaattaacttttattgaatagttaatatgtttaaggcaccctgtcatttagtcctcacaatcacccctattatcttcatttgacagatggagagactgaggctctgaaagattcatttacaaatccaaagtcatacagctagaaagtggtgaatttgcacccacatctgattctggagctggcactctaaaccagtgtgctgctccatctctccatagttgtacttctcatagaatcacaggatgttggtgcaggaaaggactgcttatatctgggtaccccacctttcatttccttcaagtcttgagatctttttgaactagaagcatgcatttagaagtgatattgatatcaccatctcctgttggtagatagatcattgagtggaaagaagagggttcaagggattctcccacctcagcctcatagtagccaccacgcccaactaatttttatattttcagtagagacggggtttcatcatgttggccaggctggtctcgaactcctgacctcaggtgatccactgccttggcctcccagagtgctgggattactcccagagtacatgagccaccgcaccaggccagggcaaaccctttcaagcaggagttccagtatactgagagatggaaatgcaattgatgtgaagtcctagcagtagcaaccagcagagctggccttcttccaggcttggagatcctctgccagatgctcatcttaccagatgcaggcagacctcttcatttcagaaaggtagacactgagggacagagagaccaaggccagcaggaagtcagtcactttagtaaagggtccaccagtctatcagtttcatgaatgtagagtctgtgcctgccttgtacacccctctatttgcagtgaccagaataagtagtaggactgtaaatttatgttataatgaattcattaccattatttaaagtggcatgttcatgcttttttttttttttttgagatggagtctcgctctgtcacccaggttggagtgcagtggtgtgatctcagctcactgcaacctccacctcctaggttcaagtgattctcttgcctcagcctcccgagtagctgagactacagacgtgccaccacacccagctaattttttgtatttttagtagagatgggattttgccatattgcccaggcttgtctcaaactcctggcctcaggtgatccattggcctcggcctctcaaagtgctgggattacaggcgtgagccaccgtgcccagaccctgtgctcttgatttcctatctttgtacttggcttttctctggccccactggtactattgttagaggtatctcatttggaggtgaaaggaggggaaataaatacagcagtcttgtcttttaaataaatacagcagtcttatgttactctactctgagatctgtctggccattgttggcaatttcatctgagcatcagcaattgctagtgacagccctacatctgggactcactttcctgtttggtataaatgtttctggagattagaataagggaagagaagtcgttttagcatttccgtatctcagttccaaagaggtttaaaaggcacgtgcaaatgacaaccccacaaaacaaaatcaactgagcaaaaatcaatgctctgcccaagagggaccatctttaagaagctttaagtgaagtttaccttgaaagttgtaattagaagcttcaggaagcaagtgcctttatggcagaatgactgatgttactcccaggatctcatggaattgtaaaattttatctctgttctgtgtaagtcaacctaaatcaaacagaaatattagtgtttgggtacatcaaaacacctttaacttgtcctttcattttggtttgccttttgacaggatataatcacagatccatttaagcttgcagaagagtctgacagtatgaagtccagatgtgtccctgatgctgctggaggctgctgtggcacaaagaaaagctgctaaatctatagccaaccaggggaccacagtagtgggcaagagtgatctgcatgttttttaacctgcttttccccatagcacagaccataagaaacaacaaatggggccgggcacagtggctcatgcctataatcccagcactttgggaggccgaggcaggcagatcacctgaggtcaggagtttgataccagcctggccaacatggtgaaatcctgtctctaccaaaaatacaaaaaaaattagctgggcatggtggtgcacacctatagtctcagctactcgggaggctgaggcaggagaattgcttgaacccaggaagtagaggctgcagtgagtaagcatcacgccactgtactccagcctgggcaacagagcaagactctgtctcaaaagcaaaaaaaaaaaaaaaaaaagaaagaaagaaaaagaaaacaacaaatggcagagagccaccatattccaaatcactgaaaaaaataaatgaattatttttatttatttatttatttttttgagatggagtctcggtctgttgcccaggctgaagtgcagtggccccatctcaactcactgcaagctccacctcctgggttcacgccattctcctgcctcagactcccaagtagctgggactacaggcacctaccaccatgcccagctaattttttgtatttttagtagagacggggtttcaccatgttagccaggatggtcttgatctcctgacctcgtgatccgcccgcctcggcctcccaaagtgctgggattacaagcatgagccactgcgcccggccataaatgaattatttttaagaggcattgattaaagattcacagcaaatcactagttaagcagattttttttctatttcctacttcaaagttctggtgccacatagtggtcagaaatggaacagagaagctgtcttaagccttgttcaagaagcaggaaaggcatcagaagaagtaacagttggcagagggtctcaggaaaaacatcttccttctgatcttttgcatagcaccttttggaattttcatcatgtttgcttattaaacaaagctcctactgccatcatactaatcatgcaaaaagattgccaaatcatgtttggtaggaggacttttgaggtagcttttgaacaaatgtttttttcttttttctttttttttgcaataaagaaaacaaattaatcataa

SEQ ID NO: 114 - DNA, 9301 bp, Homo sapiens
cctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtgggaaattttggtctctttcattggcttgctctttctctctccatcctcctccctacttgagtcctctaccctcagaccaaccccccaaggcgagttgaccgggatttctccttctccctcttaattgcaaagttgaaagggtggcgtggatttggggatggattgaactagtaagtgctactaggttattttaaagcacaagactgccatcacttactttttcccattatcaaaaagcaggctgtgtaatttctgtgcatgacacttatttatttttttttttttggtcccgtgtgtgggcctctgttcttgaggggtctgccgccttcattgtctgggttctcagtgagtaggtgaaggtaggggctggctgatgccatgccatttggtggactttaatcacaggcatttggaaaacatgtaactagcttttgtaaacccagtgcagtcctttttctcctccttaaacatccacactggcctttcaaagatcgaagtacattttctatagcttctgttcctgcttgcctggcaacttgtggggaagattgaggtctgcctttgagggtaaggggtggggtaaactaagtatcgccaaaaaaaatcacccattttggatgtgacttctcttagctagaaaagagttgttgttgttgttttaaattaaagttattaatatgtaacttggaaagattagaggttagccagccttttgtgaagaggctgtatgtcccgtagccttcttcactatttgtttacatttatctgacaacagttacagttgcccaaaccaagtgtgattttggcagaaagcttgaacctttaacagtgggatgaatccctctattggggcttatttatttcttgactctttcagtttaacgtgttctttttttccaccttgatcatccgatacattaagttgaagtatgtctccgtcaactctcaccgttccaagatgcttatacagtacatcatttatatttgttcgtttgaccatataatgaacaggtaaatagcaacttgtactattattattgaagttctgaatgtttccagtaaatagtgttatttgaaaaccaagggatgctgagtttttgaattattaagatgctagggcatgtgcaggtattgaaatgtgtatgtaacctttcgtgacctgatagtcctcaaaaccaagtttcccttcttcaaatagaattttgatcactggtagtagtctctcctctgaaaaaggtgatatgtacctggtgacagctcactggatgtgatgatctgaacatactcaaagagtgtatggttgtcctaatgccatttttctggttgaatgatgtcctctctagaacaggatcacattgtagtaagttttatgtaaaggaacagggcagaatgtgctttgaagattggtaaatttgcatttaaaagcagaaggaggttcttctggtttcttaaatagtaaaaagaaaatgtccagtatctctaggtgacatagcttcttttgggggtgtcattctttcaccactaagttgttaattagagcatctaacttctttcattttgcagtaatatctgtaatacagaaagatatattgggatgtttggaaatgcccctgaaagtctttctattgctaaatttcccaatattgatacagatgatctattgcatgagttttttattacttagaattttgcacatttactcatgaattgataacactagtttgtacttcttgctgaagtcttttcttcacttctatatctttttaccttgagaatttagtttttcacctcacagctccttaatgccgcccttactcaaaatttcaaaattcgtattattttgaaatttgtgcttgattgaccttgaacaatttttctatgatggatttattttcatgaggagctgtttttccttcagaattaccactcagtatttttttgaaatgtattctttaaatgatggaattactaatatttccctatgaattctagaaaaataataatgcacaagatttaatttttgtctttaactagaatgatgtatttggttaagaagatagtccaagttaaaggcatacattcaagctagtggcatattcggaagagcaggcaaagatagttggttgcaaatgggaaatttaagccatgatcttaaaaggacagaatggatatttgttacttaaactatgggaataattgattttttcaccttccctttcttggattttttttttattatcagtttggttactttaaccttactgtcagttatattggttcttttttttatgtctgagttaaaacattttacctgattttcatgtcttcattttctaaatcaattatgacagtgttaacaatcaaccttttatttttctctactgaataacggcgtattaaatggtttgaagactttttcttcctctacctctctcctaaattcctcatttacaaaagaaaacccaaaacaaaacaaacaaccccaacaataccaattgtaactccccagaccagttagatcatagatccagatctcattgaaaattatccttttggctaggcatggtggctcatgcccgtaatcccagcactttgggaggccaaggtgggcagatggcttgagcccaagagtttgagactagcctgggctacctggtgacaccccgtgcctacaaaaaatacaaaaattagctgggcgtggtggtgtgtgcctgtggtcccagctccttgggaggcctgaggtgggaggattccttgagcctgggaggcggagattgcaatgagctgagatggtgccattgcactacagccttggggacaaagaccctgtctcaaaaaaaaaaaaaaaaaagaaacaaaattgtccttcctagttaagaacttctgtattgaagactttcctgtatatagctgtagagaattagtctgagttgttctttattaaagaggaggaaatagaatgttctgaatgtgggaagaaaagccacctttatattagtatatgtgaatgtcttctttcttcttccttttttttttccccaagagacaaggtctcactgtgttgcccaggctggattcgaactgtgattgtcttttttctctggctaccaggaaactcttggctttatttgagacagtaattgtgctgattttacagtttgatcatgatgatggtgatgattattacttacctatgtattctgtgccaggtacaggggctggggctttatatgaatcaccttgtttaaatctcaaatggctgaatgaagtattatctccattttacaaatgaggaaattgacttgggtgaaatgatttgttcaaggtcacacagtaatttgtgccttggggttttaacttaggtctttgtgacaccagaacctgctctcttaacctctctcttatgctgctctccttgatcctggtttgacatttctattttactgagtgtgaggtttagtcttttgtctcaacactgcctcagagcctgttgggcaatagaaaagaaatgtgtttaaacatatatatggctttaaacccagtgcttctgtggtgttgtgcataacaactggtgtccccttttttgccattaaaacagttttttggcctgtgtgatcctaagtctaaagaattgtgttgacagcatttgcatatccagcatcaagattcattttggaaagttttgtactaacaatgtgctgtactaatgtgcttcttccatgggctgctctacagctgtttttcccatagctaaattatgtaatcatgtttcactattggtttcttatctgtttctgttgcaagggtcacatagtaattggtcaaactcagttttgtgttttaatcttggtttttatttacatttttgaatctatctgtataactggttgctaatgagcatcctttacacaactctgctctctgtattccatgcaaggaacctttctctttttttgtgtgtgttagttttgtagttacttacaagtctaaataagagaataaattcagtaaataccgctagaggattatgagaattttagaaaaactagagcaatgtagtgtaggggaaggaaaagcaaaatgaaaggctgccacctttgtgtgtggaaagcatgttagaggctctccattcacctgacaaaaccgtcctcacaaaagattgggccaccaagttgtctatgctgaggtgcatttgaagaatttgtaaccagttactgtttcattgtttttcttttagctttataacagttgcattccagtattgcagagcatgctatttacagctgctagggacttagccagcctcttttctagctttttcttagtaacaggtgggatcaccagataatgttgttcttcaaggaaagaatgcactgtacagttttcacctaagatattaggtaatttctttctataactcagcaaatctctccatattaatatactgagagcttaatattaaacacatttttttctcaccaaattaagtgttgtatttgccttgaatctaggaagttgtttttttttttttaattattttatacgtatttgttagggtcttgctatgttgcccaggcctggtcttgaactcctggcctcaagcaatcctcccatctgagccttccaaggtgctgggattacaggtgcatgccaccatgcctggccagaagatgtttttattagtgtttaaaggtatgaatggtgtcaccgggagctgatatatttgttttcatgatgttgtacatttatttttgtgcagtaacatacattaaatgattgtaattttgtgtgtttttagaacactattatgaaatatccagataatacagaatcagagctggaaggcaggcagcttgaggattatctagtccagtgtttgccagatttacctgatgataagatttacttggggctgggtgcggtggctcacgcctgtaatccaggcactttgggaggctgagacgggtggatcacctgaggaagggaattcaagaccagcctgaccaacatggagagaccttgtctctgctgaaaatacaaaattagccgggcatggtggcacatgcctgtaatcccaactactcgggaggctgaggcaggaggattgcttgaacccgggaggcggaggctgtggtgaactgagatcgcaccattgcattccagcctgggcaacaagagcgaaactccatctcaaaaaaaaaaaaaaaaaaaaaaaaaaaaaagatttacttgggtcacttaataagagtaaggtcttaggcctcacccagagacctctgaattgggaaagagcttttggaatccatgtcgtttacagtttccctggggtacttcttatggttaggtgagtttaggaaaaactggtctagtcagccccttgattaaggaaagtaaaccctgagaaagagaaaaaacaaagtaaatgacctatttagggccacctacctagctagtagcatcaactgaactagatcccatgtccctgacttctagattggagttcttcctgctccagcaggctggtcttctggtcccaagttattcagagatgaaggtagcagcatcattgaaaaaacaaatagtgagtgttaccgttggtttttattggtctcgtgattttcctgtcaatatgttagatgccctggattcaagcaatttttgacaagcattttattatatagaaaataagtccaagtgtgtgagctcatttttatttaattttatgttttatttttatcttagtttaactgagttttttactttgttgtggttagactaggagggtattttaggaaatgagtgttgatacctaggttatttgaagcctcaggtaattaaatataagatgttttatttgacttagcttattttggatatcctttaatgatttgttttctcattgattatttcttctgtgagagtaatgatgattggatttggttaggactgtgggggtgaagcttccttgacttttcatttctgttcacagtacatacagatctgtaaaatttccatggaaatgttcatcaaagcatttgaagcccatgtcctattcgtgcatttgtgtaccctctgtaccacacacctcccaagttttaacaaataatataagtgaaattctcacagagaatcatgctgatttgtagaagttattgcgttactaggatcaccgaagtctgagcatagacatttaggtgaggagagaccctagttaaataccagccctgactaagtaggagctggatgaagcgggaaaggaacttgtctgcgttttctcttggtttttatggggattacacactatctttcctgaagcattcttaaccattgtgaggggctggttaattttaattattagcaaatctaaacacaatttaaaatatcatcaaccaagaaaacccacaaaacagactgaactgttctgtgggttttcctgcttttacttatttattttcaaaacagggtcttgctctgttacccaggctggaatgcagtggtgctagctagcatagctcactgcagcctcgacctcccaggttcgagtgatcctcccatctcagcctccagagtacctgggaccacaggcgtgtgccaccacacccagctaatttttttttttttttttttttgagatggagtctcgcactgttgcccaggctggagtgcagtggcacgatatcggctcactgcaagctccacctcctgggctcatgccattctcatgcctcagcttcccgagaagctgggattacaggcacccgctgccatgcccggctaattttttttgtatttttagtagaaacgaggtcatgccatgttgtccaggctgatcttgaactcctgggctcaagtgatctgccttcctcggcctcctgaagtgctgggattacaagcatgagacaccatgcctgacccctgcttttattttcaatataaaattttatgtttacaagcgtgagccaccacacccagccttacataaacttttaagagcaaacctgtagagtgtaattagatgcgtagttacttataaagtggtatatatttttcaaatgagcccttttctctaaatatatatatatgtgtgtatgtatatgttattgacagtaaactttcaattcattaagatttgcttgacatataaagagtactattaaactcaaacatgtggaagtggatcactaggattgaatacagttttttaaagtattgtcttttcatctctttttgtttttctcagaacacacaaacaagaaacccaaatcataccaacactgaaaagaagagacaataagaagcattctttctttcaacatcacagacattggcaactctaggatgtctatacagagggataaaaaggggtggcagttggctgggcgtggtggctcatgcctgtaatcccggcactttgggaggcccagggaggtggatcacttgaggtcaggagttccagactgacagtctggccaccatggtgaaaccccgtttctaataaaaatacagaaaaatta

SEQ ID NO: 115 - DNA, 160270 bp, Homo sapiens
cctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtgggaaattttggtctctttcattggcttgctctttctctctccatcctcctccctacttgagtcctctaccctcagaccaaccccccaaggcgagttgaccgggatttctccttctccctcttaattgcaaagttgaaagggtggcgtggatttggggatggattgaactagtaagtgctactaggttattttaaagcacaagactgccatcacttactttttcccattatcaaaaagcaggctgtgtaatttctgtgcatgacacttatttatttttttttttttggtcccgtgtgtgggcctctgttcttgaggggtctgccgccttcattgtctgggttctcagtgagtaggtgaaggtaggggctggctgatgccatgccatttggtggactttaatcacaggcatttggaaaacatgtaactagcttttgtaaacccagtgcagtcctttttctcctccttaaacatccacactggcctttcaaagatcgaagtacattttctatagcttctgttcctgcttgcctggcaacttgtggggaagattgaggtctgcctttgagggtaaggggtggggtaaactaagtatcgccaaaaaaaatcacccattttggatgtgacttctcttagctagaaaagagttgttgttgttgttttaaattaaagttattaatatgtaacttggaaagattagaggttagccagccttttgtgaagaggctgtatgtcccgtagccttcttcactatttgtttacatttatctgacaacagttacagttgcccaaaccaagtgtgattttggcagaaagcttgaacctttaacagtgggatgaatccctctattggggcttatttatttcttgactctttcagtttaacgtgttctttttttccaccttgatcatccgatacattaagttgaagtatgtctccgtcaactctcaccgttccaagatgcttatacagtacatcatttatatttgttcgtttgaccatataatgaacaggtaaatagcaacttgtactattattattgaagttctgaatgtttccagtaaatagtgttatttgaaaaccaagggatgctgagtttttgaattattaagatgctagggcatgtgcaggtattgaaatgtgtatgtaacctttcgtgacctgatagtcctcaaaaccaagtttcccttcttcaaatagaattttgatcactggtagtagtctctcctctgaaaaaggtgatatgtacctggtgacagctcactggatgtgatgatctgaacatactcaaagagtgtatggttgtcctaatgccatttttctggttgaatgatgtcctctctagaacaggatcacattgtagtaagttttatgtaaaggaacagggcagaatgtgctttgaagattggtaaatttgcatttaaaagcagaaggaggttcttctggtttcttaaatagtaaaaagaaaatgtccagtatctctaggtgacatagcttcttttgggggtgtcattctttcaccactaagttgttaattagagcatctaacttctttcattttgcagtaatatctgtaatacagaaagatatattgggatgtttggaaatgcccctgaaagtctttctattgctaaatttcccaatattgatacagatgatctattgcatgagttttttattacttagaattttgcacatttactcatgaattgataacactagtttgtacttcttgctgaagtcttttcttcacttctatatctttttaccttgagaatttagtttttcacctcacagctccttaatgccgcccttactcaaaatttcaaaattcgtattattttgaaatttgtgcttgattgaccttgaacaatttttctatgatggatttattttcatgaggagctgtttttccttcagaattaccactcagtatttttttgaaatgtattctttaaatgatggaattactaatatttccctatgaattctagaaaaataataatgcacaagatttaatttttgtctttaactagaatgatgtatttggttaagaagatagtccaagttaaaggcatacattcaagctagtggcatattcggaagagcaggcaaagatagttggttgcaaatgggaaatttaagccatgatcttaaaaggacagaatggatatttgttacttaaactatgggaataattgattttttcaccttccctttcttggattttttttttattatcagtttggttactttaaccttactgtcagttatattggttcttttttttatgtctgagttaaaacattttacctgattttcatgtcttcattttctaaatcaattatgacagtgttaacaatcaaccttttatttttctctactgaataacggcgtattaaatggtttgaagactttttcttcctctacctctctcctaaattcctcatttacaaaagaaaacccaaaacaaaacaaacaaccccaacaataccaattgtaactccccagaccagttagatcatagatccagatctcattgaaaattatccttttggctaggcatggtggctcatgcccgtaatcccagcactttgggaggccaaggtgggcagatggcttgagcccaagagtttgagactagcctgggctacctggtgacaccccgtgcctacaaaaaatacaaaaattagctgggcgtggtggtgtgtgcctgtggtcccagctccttgggaggcctgaggtgggaggattccttgagcctgggaggcggagattgcaatgagctgagatggtgccattgcactacagccttggggacaaagaccctgtctcaaaaaaaaaaaaaaaaaagaaacaaaattgtccttcctagttaagaacttctgtattgaagactttcctgtatatagctgtagagaattagtctgagttgttctttattaaagaggaggaaatagaatgttctgaatgtgggaagaaaagccacctttatattagtatatgtgaatgtcttctttcttcttccttttttttttccccaagagacaaggtctcactgtgttgcccaggctggattcgaactgtgattgtcttttttctctggctaccaggaaactcttggctttatttgagacagtaattgtgctgattttacagtttgatcatgatgatggtgatgattattacttacctatgtattctgtgccaggtacaggggctggggctttatatgaatcaccttgtttaaatctcaaatggctgaatgaagtattatctccattttacaaatgaggaaattgacttgggtgaaatgatttgttcaaggtcacacagtaatttgtgccttggggttttaacttaggtctttgtgacaccagaacctgctctcttaacctctctcttatgctgctctccttgatcctggtttgacatttctattttactgagtgtgaggtttagtcttttgtctcaacactgcctcagagcctgttgggcaatagaaaagaaatgtgtttaaacatatatatggctttaaacccagtgcttctgtggtgttgtgcataacaactggtgtccccttttttgccattaaaacagttttttggcctgtgtgatcctaagtctaaagaattgtgttgacagcatttgcatatccagcatcaagattcattttggaaagttttgtactaacaatgtgctgtactaatgtgcttcttccatgggctgctctacagctgtttttcccatagctaaattatgtaatcatgtttcactattggtttcttatctgtttctgttgcaagggtcacatagtaattggtcaaactcagttttgtgttttaatcttggtttttatttacatttttgaatctatctgtataactggttgctaatgagcatcctttacacaactctgctctctgtattccatgcaaggaacctttctctttttttgtgtgtgttagttttgtagttacttacaagtctaaataagagaataaattcagtaaataccgctagaggattatgagaattttagaaaaactagagcaatgtagtgtaggggaaggaaaagcaaaatgaaaggctgccacctttgtgtgtggaaagcatgttagaggctctccattcacctgacaaaaccgtcctcacaaaagattgggccaccaagttgtctatgctgaggtgcatttgaagaatttgtaaccagttactgtttcattgtttttcttttagctttataacagttgcattccagtattgcagagcatgctatttacagctgctagggacttagccagcctcttttctagctttttcttagtaacaggtgggatcaccagataatgttgttcttcaaggaaagaatgcactgtacagttttcacctaagatattaggtaatttctttctataactcagcaaatctctccatattaatatactgagagcttaatattaaacacatttttttctcaccaaattaagtgttgtatttgccttgaatctaggaagttgtttttttttttttaattattttatacgtatttgttagggtcttgctatgttgcccaggcctggtcttgaactcctggcctcaagcaatcctcccatctgagccttccaaggtgctgggattacaggtgcatgccaccatgcctggccagaagatgtttttattagtgtttaaaggtatgaatggtgtcaccgggagctgatatatttgttttcatgatgttgtacatttatttttgtgcagtaacatacattaaatgattgtaattttgtgtgtttttagaacactattatgaaatatccagataatacagaatcagagctggaaggcaggcagcttgaggattatctagtccagtgtttgccagatttacctgatgataagatttacttggggctgggtgcggtggctcacgcctgtaatccaggcactttgggaggctgagacgggtggatcacctgaggaagggaattcaagaccagcctgaccaacatggagagaccttgtctctgctgaaaatacaaaattagccgggcatggtggcacatgcctgtaatcccaactactcgggaggctgaggcaggaggattgcttgaacccgggaggcggaggctgtggtgaactgagatcgcaccattgcattccagcctgggcaacaagagcgaaactccatctcaaaaaaaaaaaaaaaaaaaaaaaaaaaaaagatttacttgggtcacttaataagagtaaggtcttaggcctcacccagagacctctgaattgggaaagagcttttggaatccatgtcgtttacagtttccctggggtacttcttatggttaggtgagtttaggaaaaactggtctagtcagccccttgattaaggaaagtaaaccctgagaaagagaaaaaacaaagtaaatgacctatttagggccacctacctagctagtagcatcaactgaactagatcccatgtccctgacttctagattggagttcttcctgctccagcaggctggtcttctggtcccaagttattcagagatgaaggtagcagcatcattgaaaaaacaaatagtgagtgttaccgttggtttttattggtctcgtgattttcctgtcaatatgttagatgccctggattcaagcaatttttgacaagcattttattatatagaaaataagtccaagtgtgtgagctcatttttatttaattttatgttttatttttatcttagtttaactgagttttttactttgttgtggttagactaggagggtattttaggaaatgagtgttgatacctaggttatttgaagcctcaggtaattaaatataagatgttttatttgacttagcttattttggatatcctttaatgatttgttttctcattgattatttcttctgtgagagtaatgatgattggatttggttaggactgtgggggtgaagcttccttgacttttcatttctgttcacagtacatacagatctgtaaaatttccatggaaatgttcatcaaagcatttgaagcccatgtcctattcgtgcatttgtgtaccctctgtaccacacacctcccaagttttaacaaataatataagtgaaattctcacagagaatcatgctgatttgtagaagttattgcgttactaggatcaccgaagtctgagcatagacatttaggtgaggagagaccctagttaaataccagccctgactaagtaggagctggatgaagcgggaaaggaacttgtctgcgttttctcttggtttttatggggattacacactatctttcctgaagcattcttaaccattgtgaggggctggttaattttaattattagcaaatctaaacacaatttaaaatatcatcaaccaagaaaacccacaaaacagactgaactgttctgtgggttttcctgcttttacttatttattttcaaaacagggtcttgctctgttacccaggctggaatgcagtggtgctagctagcatagctcactgcagcctcgacctcccaggttcgagtgatcctcccatctcagcctccagagtacctgggaccacaggcgtgtgccaccacacccagctaatttttttttttttttttttttgagatggagtctcgcactgttgcccaggctggagtgcagtggcacgatatcggctcactgcaagctccacctcctgggctcatgccattctcatgcctcagcttcccgagaagctgggattacaggcacccgctgccatgcccggctaattttttttgtatttttagtagaaacgaggtcatgccatgttgtccaggctgatcttgaactcctgggctcaagtgatctgccttcctcggcctcctgaagtgctgggattacaagcatgagacaccatgcctgacccctgcttttattttcaatataaaattttatgtttacaagcgtgagccaccacacccagccttacataaacttttaagagcaaacctgtagagtgtaattagatgcgtagttacttataaagtggtatatatttttcaaatgagcccttttctctaaatatatatatatgtgtgtatgtatatgttattgacagtaaactttcaattcattaagatttgcttgacatataaagagtactattaaactcaaacatgtggaagtggatcactaggattgaatacagttttttaaagtattgtcttttcatctctttttgtttttctcagaacacacaaacaagaaacccaaatcataccaacactgaaaagaagagacaataagaagcattctttctttcaacatcacagacattggcaactctaggatgtctatacagagggataaaaaggggtggcagttggctgggcgtggtggctcatgcctgtaatcccggcactttgggaggcccagggaggtggatcacttgaggtcaggagttccagactgacagtctggccaccatggtgaaaccccgtttctaataaaaatacagaaaaattagctgtgcgtggtggtgggtgcttgaattcccagcttcttgggaggctgagacaggagaatcacttgaacttaggtggcggaggttgccgtgagctgagatcacgtcactggacgacaaagtgagactctgtctcaaaaaaaaaggagggggtggtggcaggctttcgaaggaggaactagaggtttgtggtctagcttagatgttgatggataatggggatgccaaaccctctccctgtgttacattagtgctatgactgaacataaacactgctgtaatggacggtgagatcttcgtgtcatcctatttaaccctcccttgctgtcattcggaggtgggagtgcttctttttgaattcacatgctgtggggaggatagcatctgttaatgcaaaggttaagaacaatgtgctcttcctggatctgttttggacaagtaacttatcctctttaaccctaagtttttttcaaagtaaaatggggatattttctaactcatatggtacttagtaagaattattgtactaataaatatataaatgtttctaacagtacctggcactttgtgcttaaccagtatttttattataacaattctttctgtaggctcttggttgttatcttagtctgtttgtgctgctgtaacaaaataccacagactgggtaacttaaaaataatagaaggtggccgggcattgtggctcatgcttgtaatccctgcactttgggaggccgaggcgggtggatcacctgaggtaagatcaccagcctggccaacatgatgaaaccctgtctctactaaaaacacaaaaaattagccagctgtggtggtgggcgcctgtaattccagctactcaggaggctgagggaggagaatctcttgaacccatgaggtggaggttgcagtgagccgggattgcgccactgcactccagcctgggcaacaagagtgaaactctgtctcaaaaaaaaaaaaaaaaagaaatttatttctcagttctagaggctgggaagtccaagatcaagacactggcactggcgtctggtgagagccttcatatggcatcctcacatagcagagaaatggaaggtgaaaagggcctaagctagttccctccagcacttgtatgaggcgctggttcagagtccccatggcttaatcacttcccccaaaggccccacctcttaatatcactactgtggggattaagtgtcaacatgaaattttgagaggacgcattcaaaccatagcaattgttcttggtcattctcttgactggagcctgatagtcaagagagacattttagcgtgtgtccttataattattattggtgttgaaatctaaaagtggctaggctcgctgggcgtggtggctcatgcctgtaatcccagcactttgggaggcctaggtgggtggatcacttgaggtcaggagttcaagaccagcatggccaacatggtgaaacccagtctccactaaaaatacaaaaattagccgggcgtggtggcatgtgcctgtagtcccagctacttaggaggctgaggtgggagaattgcttgaacccagggggctgaggttgcagtgagccgagatcatgccactgtactccgcctgtgcgacagagcgagactctgtctcaaaacaagaaaaaaaagagtggctaggctgggtgcagtggctcatgtctgtaatcccagcactttaggaagcttttaggaaagctgaggcagaaggattgcttgaatctaggagtttgaggctgcaatgagctgtgattgtactactgcattccagcctgggtgacagagcaagagcatgtcttttttaaaaaaaaaaaaaaaaagtgactagttattgtaggttttttcttttcctttttgttgtgattgaatcctaagctttgttattttcctagcagttgacaaggtgactacatgcatatatatttttaaggaaaacagaacaatttattataggttctactttccttagagtaagaatactgtgttttaaaataattcttcattctctttaatcataaacaactgaaaaagacaacaagtcttttgagttgtttatccgctcatccgttgatagacatttagacagtttccactttttggccattatgattggttattatgaataatgctgctgtgaacattggcatgcattttaaaagcaagtgcttgtggattttggaagcccttgaataaccaaagacttttaagactaaaggaagatcaaaaaagataaaatattttaacactgattgcataaaaagtataaaaaatggtaatgcctaatatagcaagtttgtattgcttatagcagtgtaaatttataatgattttggaaggcaactgggtgtcataaaaatgatttagtatttttttcccctggaaatcttaattcagtgatccaagagaagaaaagagctatgttagctttttatgttgtatgtgtgttgcagcgttatctagaaacagtgaaaaattggaagtaaatatctaacacttcaaggcaaggagtggaggagaaagagttaagaaaattataaatgtgaactatttccaaccattcagtgataatcttgaaagccacatagcaatatgggaaaatttgcactgattatttgcacggaatatagacatgcaaaaaaatatatatatgtatacactggaaggtaacgtggaaaaaatgaaaatagttgatgtattagggtggggtgatcatagccagtctttgtgaaaatctccttgttaactttgtacatgatatacctggaaaaaattcaaatctgctaagaacattatgaatcctgatcttgtgaaaactaaccattgctcgtattaaggaactcattccatttctcttgaggaacattttactgctgaaacagttggttcttttttaaaattttaaaaattgagatataattcacatatcttaaaactcacccttttaaagtatgtgatttgatgctttttggtatgttcacaaggttgtgcagtcattactactgtctacttacagaacattttcatcaccccgaaagaaactccatacctctttgcagtcacttctcattttctgttccccctagtcactggcaactaatttactgtctgtatggattagcttattctggacatttcatataacatgtaaatgaaatgtggccttttgtggctggcttctttcatttaacatgttttcaaggttcatccatgttgtagcatgtatcagtatttcattcctttttacggccaaatattcagttttatagatataccacatgttgtttatccactcatcagttgatgggcatttcgattgtttccactttttgcctattaataatgattctatgaacattggtgtgcatgttgcattcttgacaaatcccattctagtctgaagatagttcagtggtctcatagagtaggactgtgatttagtttgggcatgttattggggtgagttctgagcaacttaaaagtgtgtgagtcacaactaccttccttccattggtctgtactgggcttctgcctcagtgcccctgcttggtatgtcttcatgaaggatgttttaaataatgagcaatactaaaggcacagaaaaccaacctattgcaagttggccatagagctggagcagggtctcagaagcccttctgttaggccagatgttaatcttttagtgttaagagtgtggacatgtatttccttctttcttttttttttttttttttcgagacagtttcactcttgttgcccaggctgtagtgcaatggtgcgatctcacctcaccgcaacctccgccttcccgggttcaagtgattctcctgcctcagcctcccaggtagctgggattacaggcacgcaccaccacggccggctaattttgtatttttagtagagacggggtttctccatgttggtcaggctggtcttgaattttcttcctcaggtgatccatccgccttggcctcccaaagtgctgggattccaggcgtgagtcacagcgcccggccatggacatttatttctaattctcttggatatatacacgggaatagaattgctggatcatatggtaattctattaactttttgagaaactgccaaactgtttttcaaagtggctgcaccatttgacattcccatgaataatgtatgaaggttctaatttctccagcatcctcaccagcacttgttattgttaaaaaaaaaaaaaaaaaaaagaatgccatcctagtgagaagtggtatctcatcgtggttttgatttgcatttccttaatgactaatgaagttgggcatctcttcacgtgcttactggccatttctataactttggagaaatgtctatgcagttcttttgcccatttttaacttgggttatttgtctttttattgttgagttgtaagagttctttttatattctggatactagtcacttgtcagatatatgatttgcaaatatttttctcccatgctatatgtcgtctttttactttcttggtagtgacctttgaagcagaaaaaggttttaattttgattgagtccaacttgtctttttttcctttttttttttaactcattttttgagcaacggggttttgctatgtgcctagggtggtcttgaattcctggcctcaaccgatcctccagccttggcctcccaaagtgctgggattacaggtgtgagccactgcaaccagctctattttttttcttttgttgcttatgcttttggtgtcatagctaagaaaccattgcctaatccaaggtcacaaagatttatgcctatgttttcttctaagagttttatagttttagctctttcatttaagtcattaatccattttgagtttttatatatggtgtgagggatgggtccaactttattgttttgcatgtggctattcagttgtcccagtactgtctgttgaaaatactattctttctccattgaattgtcttgacatacttgtcaaaaatcaattggtaaccaggcacggtggctcacgcctgtaatcccggaaccttgggaggctgaggcaggtggatcacttgaggtcaggagttcaagaccagcctggccaacatggtgaaaccccgtctctactaaaaatacaaaaattagccagcgtggtggtgcatgcctgtagtcccagctgatgaggaggctgaggcaggagaatcgctttaacccaagaggtcaaggttgcaatgagctgagattgcaccactgcactccaggctgggtgacagagcaagactctgtctcaaaaaaaaaaaaaaaaaaaaaattggccatacatttgagagtttacttctgaaccttaagatctgttccactgatctttaattttatgtcagtactacactgttttgattactgcagctttgtaataagttttgaaattagaaagtttgaatcctccaacttcattcttccttgtcaagattgttttggctgtcaggattccttgcatttccatgtgaatttttcagggatcaacttgcccatttctgcaaaaaaaggcagttggaatttacataggggcattgcatctgtagatcaatttaggagtattgcaatgttaacagtacaaagtcttccatccatgaacggggatgtcatatcatttatttaggtcctctttaatttccttcaacaacgttttgtagttttcagtgtgcttgcaatccttttgttaaacttattcctaagtattttattttttgatgctattataaatggaattgttttattaatgttatcttcagattgttcattgcttgtatatagatatacaagtgatttttgtatgttgatcttctatcctgcaaccttgcagaacttgttaggtgacaaatggttcttaagatagaaaaatgcttttaaaaaacatgagtttgttgaggttatcttacatttacttctttaatttgcttgtagtggattttgtttttttaaaaaatgtagggatttttacttgccacttttatatgtagatattgaaatatccacaattggttattgacagtcatttaggaaatttgataggaaagactaaatttttttttaagacagggtctcattagcacataaatacgtattaactgtctgacacaaaatcaagtattagtccaggaagaaacggatatggaattgggaagatatacaccatcaggcacttctgtgtttttgtttgtatttgtgacagggtctccctccattgcccaggccagattgcagtggtacagtcataactcactgcagcctcaaaccctgggcacaagcgatccttccacctcagcctcccaagtagctaggactataggttcctgccactgtgcccagcttattttaactttttttttttttttttggagagacagagtctggctatgttgcccaggctgatcttgaactcctggccttaagcaatcctactgcctcagcctcccaaaacactgggattacggatgagtcaccatgcctgccataaaagagtaagttttctgtcccagattagataggaaaagaagaaataggttgtataaaatgtcagtcaagacaaaaaatatgcctggctggagcttaggagtttaaaagcaagtctatttctttctttctttctttctttttttttttttgagacagagccttgctctgtcgcccaggctggagtgcaagtgctgtggtgcgatctctgctcactgcaaactctgcctcctgggttcaagcgattctcctgcctcagcctcccaagtagctgggactacaggcgcctgccaccacacctggctaatttttgtatttttagtagaggtgaggtttcaccatgttggcgaggctggtcttgaacttctgacctcaaatgatccacccacctcggcctcccaaagtgctgggattacaggcatgagccaccgcgcccagcctgagccaccggccaaatctatttctttctactatttagagtggctttttatcagtctagggacttgggattggagataagcacagaaagactagctaatatctaaatgttttcgtaaaccaggtgttgtggcacgcacctgtagtcctggctacttgggaggctgaggtgggaggatcacttgtgcctgggagttcaaggctgcagtgagcaagctatgattgtgtcactgtacaccagccaggtgacagagtaagactcctgtatctaaaaataaaaagtttaaaaatgattttgggctgggcatggtggctcatgcctgtaatcccagcactttgggaggctgaggagggccaatcacctgaggtcaggagttcgagaccagcctgaccaagatggtgaaaccccgactctaccaaaaatacaaaaattagctgggcatggtggcgggcacctgtaatcccagctacttgggaggctaaggcaggagaattgcttgaacccaggaggtggaggttgcagtgagccgagaccgcgccattgcattccagcctgggcgacagagcgagactccatctcaaaaaaaaaaaaaaaaaaaaaaaagactttgggccagacatggtggcctgtaatcctagcgctaactttgggaggtgggaggattgcttgagtccaggaattcaagaccagcctagacaatattgggagaccctgcctctacagaaaataaaaagaaaatgggtgtggtggtgcacacctgtggtcttagctacttggggggttgaggtgggaggatcacttgagccaggaggtcaaggctacagtgagctgtgatcacacctctgcaatccagtctgagcaacagaggagacctcatctcaaaaaaaacttttgtagtatctttcttctccacatcaatttatcaagggtcttctttggttttatttgcaaagactagaagaaaccctgacttctgttactctgcatttcttactgctatgagcagtatggtcctttaaaaaaaaatttttttttttttttttttgagacagggtcttgctctattgcccaggatggagtgcagtgacacaatcacagctcactgcagccctggttgactagcagcgctcaagtgatcctcccgcctcagcctgccaaatagctgtgatcacaggcacactccactgcacctggcttttttttttttttttttttttttgtagaaggcaaagtgtcgctatgttgcccaggctggtctttaactcctggcctcaagcagtccttccaccttggactcctaaagtgttgggattacgatatgaaatgccacgcccggcctagcactataatccttgaggtttttgggttccaggtgaccagaagagacaaaatgaaactctatggtgtttttttttgtttgtttttttggttttttttttggtgctgtgggggtagggggctggtaatctgagagggagaatgttttcccatgctagcaaagacagattgagggcatcatctgatctttatgggagtgtgcaaagcctcagtttttccatttgcccatctgcaatcatagaaacaatgtgctgactcaactcggagcctctgcggagtggcgtttgggtttagacagtcctcagaatcattcaagagatggaaatatttgagcaggtcttcagaggtaaaattaaaactaaaaacaactagaacaagatagcatgctttcttatctctttcaagattatttcctttagtcactagtgtacctccttgatgtaaggtttggcaggaataatttcatctctgtagagttgataactaagcagagaaaaaaccctaccttttagtcattgcttttcatcttgctatcatcagtctgatccttgagggtttggggttccaggtaaacagaagagacaaaatgaaactctttgcttttttttttttttttggtgcaatgggggtgggggagattgggtgtggagaggggtgagattctgctggaaacaagtcaattggctaaaatactcttttaatcatattttgtggaccatcttctgcttagttttgctcttttatgtttttatttgcttgttcatatatacatacattaacctgcaacaactagaagaacatttaccaaaatattaaccaacagtgactatcttttgatgtggtgggtttaggggaggaagtatgtttttctgtgttgctccaagtttttctgtttaaagcatgtattttgtaatgtttgggggaaaccaaatccatcaaaataaagtgcaagttttgtaacctgaaccactcattgaggtacagaattgaaatgtatttagatgaaactcacaggtattttttcttggagaatgtggaatattttatctatagtgcagctgtgctgtcatttatgccattttttcctcctcattgtgattcttactgtttggggtgaaagatgagtagtattttaaagcccgtaatgtgtgtgagtacacacgtgacatcttagtaagattcattttgtgtgagaaataagggaatttaggcttttgggttacatttgttttcaaaacatgttaataggtgacaaaaatccagtttgtttagatttgtatgtagtctgcctggaatgaaacttttttatacttacatgatagccctgattaaataaaagtttggtgaaagccagcagggtggcatgtgccccatgatcccagctactcttgaggctgaggtaggaagatagcaagttcaagcccagcctgggcaaaatagcgagaccccatctcaaaaaaaaaaaaatgttttgttaagtagttgagttccaactagatctgtacttttaacataaagctataatcccaagatacctcttatttggggacatgatggttttggaaactggtgcttccttttgtctaaataaataatcactgtaaatctagtcttgattattaaaaggagacaaaaagataaaaggagtgttctgaaccacctgtgcttgaagctcagttaatagtttccagactattaagcctacaaaatgtatatcttacacattttgctaaaataaaaagaccttttagctttgatcaagacaagatcaaatatttggtttgattatactcctaaaacgtacatattctcagacagataaacagatgtgattttctttcgttctttttctggatgtatacagaaaccttttttttttctttttttggtagagacaggctctccctatgttgcccaggctggtctcaaactattgggctcaaacaatcctcccaccttggcttcccaaagtgttgggagtataggcatgagccactgcacccaaccccagaaacgtttaatttaactataggataagttagctatcatttaggtgcctttactaaagtctgttaaaatgacataaaataatgacaatgtgtggggcgcagtgactcacgcctataatccaagcactttgggaggcccagttgggaggatggcttgagcccaggagtttgagaccagcctgggcaacatagtgagacctcatctctacaaaaaaattaaaaaattaggccgggtgcggtggcacgtacctgtaatcccagcactctgggaggccgaggcaggtggattgctcaagatcaggagttcgagaccagcctggccaacatggtgaaaccccatctcttctaaaaaaaaaaaaatacaaaaattagctgggcatggtggtgggcacctgtaatcccagctactcgagaggctgaggcaggggaattgcttgaacccaggaggcggcgcttgcagtgagccaagattgtgccactgcactccagcctgggtgacagagcaacgctctgtctcaaaaaatggaaaaaaaaaaagaaaaaattagctgagcatggtggcacacacctgtcatgctggctactcaggaggctgaagtagggggattgcttgagcctgggaagtagaggctgcagttagatgggattgcgccactgcactcctgcctgggtgacagagtgagaccctgtctcaaaaaaaaaaaaaaaaaaaaaaaaagacaacgcctctactcctttagccaactttctaaaaaaattaaacattttagggagagaaatcgatgtttcctttacttacagatggcattgctcttaaatagtcctatgcctattagacagttaaatttaatttttactgagttccttgatattaaaaatataccagcgttttgacctgattactgtagagtgaagatcatcagttgacacagaacttccagccagcattttaatgctttcctctgaaatatgaatggacagcgatagatctctgaatatttgaggagagcctctaataggagttatggagactaaaataaacaagcagacaaaggcccttagttgatttaagctgatttatctcacattacctaaatatccaaaaagtcagcagttattactttatctgtgacctcccaaagccacttaccaaaccaggtatgagtagcaaattcgaagatttgttgcctttttcagacatggtgtaggtaggatctttcctgtattcattcaacctgcctagttgtttgaggatcccagccaggttgaaggttgtaaatatttccttaaggcttacttagcttcagtgcaggatcagaggctaatttctggcagagttctatgtcttaggggatcattagctgtctatttttcctttctctttttactgcaagatttcttcaagaatagctagttacttccttttccttgccatctttaatcctctacaatcttgtttcaaacagttacaacccatgacttcttttattgccacatctacatcttggttgttacctttcctctcttgcttggcccctttactgtttttagctgtaggtgaggaccactcttcaggttggctcctgctgtttctctgactgcttcctttttctttttaggttcttgattttcccttccatttctaattgagcagtccccaagattttgtccttatgtctccttccatgttctttttccatcttgagaagactttctttgactcatctttaatccataagcatgtatttagcatcataataaagaactggcggccaggcgcagtggctcacgcctgtaatcccagcactttggtatggacgaatcacctgaggtcaggagttcaagatcagcatgaccaacatggtgaaacaccgtctctactaaaaatacaaaaatcagctgggcgtggcgcacacctgtaatcccagctactcgggaggctgaggcaggagaatcgcttgaatccgggaggtggaggctgcagtgatctgagatcgcgccactgcactccagcctgggcgacagggtgagtctccatctcaaaaaacaaacaaacaacaacaacaacaacaacaaaaaaaaaaccgccatgtaggagacggccaaagaggaattagacagatttcctgctctcaggtaacttgaagtacatatgaatttatactcttttccattctgtatcttcttttttaaaaatttttatttttagtagatgtggggttttaccatgttggccaggctggtctcaaactcctgacctcaagtgatctgcctgccttggccttccaaggtgttgggattacaggtgtgagccactgcgcctggcctcccctctgtatattgttatcaaacataattgatctgttttgaaaacgcatcttttactttttgttttctctccattcccactgctacagtgccagcccttagcccctcttatttgtgcttattatgttttgggtgctccagaaatacattttgttttattttattttatttatttattttttgagatggagtctcactctgtcacccaggctggagtgcactggcgcaatctcggctcactgcaagctccgcctcccgggttcacaccattctcctgtctcagcctcccaagtagctgggactacaggtgcctgccaccatgcctggctaattttttgtatttttagtagagacagggtttcaccgtgttagccaggatggtcttgatctcctgacctcgtgatccgccctccttggcctcctaaagtgctgggattacaggtgtgagccaccgcgcctggtccttattttattattatttttttgagatggagtctcgttctgtcacccaggctggagtgcagtggcactatcttggctcactgaaacctccacctccagggttcaagtgattttcctgcctcagcctcccaggtagttgggattacaggtgcctgccatcacgcctggccaaatttttatatttttagtagagatggggtttcacactatgttgtccaggctggtcacaaactcctgacctcaagtgatccacctgccttggcctcccaaagggttgggattacatatgaatttgtactcttttccattctgtatctgggtgatacagaatgtgtgagccattgcgcccagcctagaaatacattttaaattaatgcatgaatcagtctattttgattatcattaaacttccaagatggctttctttattgtctgtttcatcaagcatacctctgccaggctgatcttccttaaacataactttcatcttaccagtttgttaaaaacctcttataattacagtaatatgatattgtctttattttattttttattttataaaaaattacgtagtagagatggggtctcgctatgttgcccaggctggtcttaaacaactgggctcaagtgatctgcccgccttggcctaccaaagtgctgggattacaggcgtgagccactgtgcccagttgatattgtcttttaacaagtcaaaatagccagcataaaaaaaaatgatcatatacaactggcaaggtcccatgggatatggccccttctttggctgcatctcctactcctccagcagctacagtgacctctggctgtttcctgagtgccacaggtactctaggcatgcccctgccttggagcctgtgttgttgctgctccttctccctggaatgtcctttcgccagatagctttgcagcttgctccctccttccttcagatctgtactcagatatccccgctgtggccaggctgtccatggcagtcttacgattccagcccctctcctgcaactttttctccttagccctctactgtactatatcttattcatcttttttctttttttttcacctgcctctcctactagaacgtaagctccataagggcagggacttgtctgtcttgttcactgctgcgttgccagggcccacagcagggcctggcacataggtgcttaatagatattgttgaatgattgaactgaatattgttgagaatgtgttgtgatactagtactcttttatgctactgatggtagtgttaatttgtataatcttcctaggaagccatttggctctatatttaagaacctgatactttttgtatatcttttcacctagtagctccacttccagaatgtgatcttaggaactaatcagaaatacatgtaaaacttaaaacacagaggtgctcatttaaatttctatttatttttaaacatttctgtaaaatataacataaaaattaccattttaaccatctcaagtatacgattcagtagtattaagtacattcacatggtgtgccaccattccagaacgcttttcatcttgcaaaactgaatctctatacctattaaacaaaacttcctattccccaattcccagcccatggcaaccaatgttctactttctgtctctatgattgtgacttctccaggtacctcatataaatggaattatatggtatttatctttttgtgactgacttattttactttatgtaatgttctcaaggttcatccatgttgtagcatgtgtcagaaattccttctttcttaaggctgaattatgttccgttgtgtatatgtgccacattttgtttatccattcgtctgttgatggacatttgagttgccttttggctattgtgaataatgctgctatgaacatgggtgtgaaaacatctgttggagtccctgctttgagttcttttggatatataaccagaagtggaattgctaggtcatatagtaattctattcttaattttttgagaaactaaatagtttttaaaaatagcaaaacattataacagtctaaaagtccagcattgaagaatagttaaccaagtctagctatatacatatgatgttgccagtagagttacatttataaagtttttaataacatgggggagattattattttaagtgaaaagagcaacatggtttcaactgtgttttaaaaactgcattgcagtccaggcgcgcctggatcacaggctggttcacgcctgtgatcccagcactttgggaagctgatgggggtggatcacctgaggtcaggagttcaaaaccagcctggccaacatagtgaaaccccatctctactaaaaatacaaaaagtagccaggcgtggtggcacactcctgtaatcccagctacttgggaggctgaggcaggagaattgcttgaacccgggaggtggaggttgcagtgagctgagatcgtgccactgcacttcagcctgggtgacaaagcaagactctgtctcaaaaaaacaaacaaaaaccaaaaaaacccaccaaaaacaaaaaaagaaagctgcattgctgggcatggtggcatgcacctgtagtcccagctccttgggaggctgaggcgggaggatggcttaagcccaggagttcaaggctgtgtagtacattatgatctcacctctgaatagccactgcactccagcctgggcaacatagcaaaaccccatctctaaaacaaaaaacaaaaaaaaattacatacaaaactggtaggagatacactgaaatgttaataaaaatgaggtgatatctatatgcatctaattttcttctgtactttctaaattgagcaggcattacttttattatttaggaaaaaaacgcacaaaaaaagtcaagagtactcattaccaactactactgtatggaatccagagccttccagagtttgtagagctcttcatactctggctctagcccttgtttttattttctgtctaaaatggctaatctcataactgcatgtcatatatgtgtataatatatgtatattcatatgtatgtctgtatgtctgtgtgttgtatatatatgtgtttatgtctgtacacattgtctgtagttaacacacctctgctcatgttctcatcctaaagagtacttagttctgttcgtctaaaactctgctcagcctttaatacctagttacaattccattgttttcttgaaatctatgctgacttctgaacttctataccccttatacctaagggatccgtaagtttacatatatgtaagattggcagaaaattaacctacaattaaaacctcacatttcttaattctctttaatctttaagttgctactttcataattctttttttttttttttttgagatggagtcttgctttgtcgcccaggcaagactggtgcgatctcggctcactgcagtctccgcctcctgggttcaagcaattctcctgtctcagccccccgagtagctaggattacaggcacccaccaccacgcccagctagtttttgtatttttaataaagatggggtttcaccatattggccaggctggcctcgaactcctgaattcaggtgatcgcctgccttgacctcccaaagtgctgggattacaggcgtgagccatcgtgcctggcctgctttcgtaactcttatagtacctgtctggaaaatgccctggcttttctctgcttatctaattctcattcatcctactcccctgcaattttttattttgaaaataattccagcacagaaaagtttaattggtacaatgaattcccttatactcttcatctacattcaccagttgttaatattttgccatatttgtatcttttcgtgtgtgtgtgtgtgtgtgtgtgtgtgtgtgtgtgtacatcttttcttcctggaccattggtcatttgaaagtaggttgcagacatcatgatacttcactcctaaacacttcagcatgtatctcttaagtatgttctcccaaataagcacagtaccatgatcacacccacgaaatttaatgtcagtacaaacatattatctaatattcagtccacattcattcacttggcatgtctctttgatgtccttttatccagaatagctcctttgcctttttttctttcatgacattgacatttttggagtccgggctagttgtagaatgttctgcaatctggatttatcttatcttctcataattagaagcagggttaaatatggttttgttttgttttttgtttttttttttggcaagaataccacatagtaaaaagtaccttcttcccttaataattaacaaggaatctatgaggtgatatttttagattgtgtacatatcctgtatcccccacaaactcacccaaggattttggcatctcactcctccctttaaaaagtatgactctgcaaagccttctttgtccatccttgtctatagtaacctgtttcttttcccattcaagcatcgaaataggcgtttaaataagaaggggaagaagtgaatgtagttcaaagcaccttattttccagaggagtgtttagtgttttgcccaagagcaactgtgtagttggtaacaactgttttaggactagaacctgggtttcctgattcttatctagtgctatttccagctgcctcttagtgacccctaaccaataagacaaaacaaatacagtataatctcaaatagagtataacttttttgcaagtagaaagaaagcatatattatgttttcttttgcgtacattcctttattcatttattcaaaagaggcagatcagcctcctctcctgctccccccactccatccccctgcgccccacagtgtcctttaccctccagccacactgaagcagagctccaggctctctcctctctctgcctgcttctgtgcttccctttggcttgttccattctcccttcccttgttgttttctcctaagcattacatgagcttagctagttgctcagaggaggcctttacctacctgcaggctatgttaggtaccctcttctgtgttattgtaagactctatgtatccatgtttatcttttctttttttccctttgggtaattgttgtttacaatttcttctcgcaggatgatgagctccttgaggtcaggaattttgtttagtttgccttgggcctgccacttggaggtgctcagtcgatatttgctttacctgtaaagctacttcatctctgtggtcattgattactttaccataaaggcagggttgagactcagacctccacgtctctccagttttgacagcttccataaatatttgatctataatgtgcaaggcagtgtggaaaatgcaaagccattttacgtgttgagcaagtccttcaggaacatgggggaaagtcctggctgtagttataaaaagacagaatgagttcattggtgctgcagggaatgttacaaagtgctttagcaatgggaagatgaaggtgttcttagggcagtctcaaaggaggccagaggctgggggagggtcagaacattttagttgcagggaccaatactgggaaaggcacagaggcagaaaggttgtgtttgggagaattgtgagcagttgatttgactggctcttaggattctttgccctacatttaatgtacatattgattattcttgtgatatattgattgttgtccggaatcttttccattttgcttttagggatacctaaaagcaattagtgatactaattgaacttgtatattgacagaaaagtctctcacgggggtaatttctatcatgcaggacttttttaaagcacttgtgctagctgttgtttgaatcaaagtattgtttttttaaagatctattcttccctgcttgtgcaactcctttgagcccaaattcttcactcctaggttaaacagggtaagcttcaggggaagtacattaataattgaacacccgtgaggtgttactgcttctgttctgcacttttagtgttttctgtagcctgaaagagttacttcactattttgatttgcaaccgggatagaacttgaagcaccgttaagaaaggattggagactttgtcatggtacttattttccagatgtttactttttaaataaggaaaaactacaacatgttaataaccaacttggaaaaaacaatattgtgatctgagaaagaacaaaacacatgccatacttaatatgttagtatccattttttccccttcaaatacaattctgcatgtatctgagtagctcttcaccaaatgccagaactttttactcagagtaaatgttgatgagataggacatgtgaaccattgaagaactgattttttttctcataaatactaacttactctgaactagtttatagttactaaccccactgccataaattctccagtcatatgttttgtaatcccttccctggcatacattttaatcattttcctactgcttcataggtactataatccttttatagttccctgggttttaaaataaccctataaagggttcagttttatatttaatagtcatgtttcacactgttctaaagctgtgaataagttcaggcaagcagaagtttctaatttgaaacgactttgtttctgttttagaaagatgtatgcgtcttctagtgtttttcattgtgatgatgttatatattggctagaattttaaaaatatttggaaatacttataaagtgaagaaaaatgaagaaaaaaaaccactgactgctgagcacagtggctcgcgcctgtaattccaacactttgggaggccgaggtgggcagatcacatgaggtcaggagtttgagattagcctggccaatggtgaaaccctgtctctactaaaaatacaaaaattagctgggcgtagtggtgcacgcctgtaatcccagctacttgggaggctgaggcaggagaatcacttgagtctgggagatggaggttgcagtgagctgagtttgcgccactgcactccatccagcctggttgacagactgagactctgtctcaaaaacaaacaaacaggccaggcgcggtggctcatgcctgtaatcctagcactttgggaggccaaggcgggcaaatcacgaggtcaggagatcgagaccatctggctaacacggtgaaaccctgtctttactaaaaatacaaaaaaaaattagccgggcgtggtggcaggcacctgtagtcccagctactcaggaggctggggcaggagaatggcgtgaacccgggaggtggagcttgcagtgagccgagattgcaccactacactccagcctggggatagagcgagactccctctcaaaaaacaaaaaaacaaacacaaacaaaaaccccacacaggtaaaaacattcatcttgtaattttctattatcaggtttcaaaagatcacttctttcttgaaacatacattgtatgtcttttggtgaacaagattgttgttgtcttcctggtgctgacagtttggtgggggagatagacatgaagcaaatcatcacacgaataaactcatctgcatgtgctgtgggggagaagtacttagtgccctgagaatattggcaggtgggacgggagggaagaaagtagcttttgggtgacttgagatctgacagataagtaggcgtcaactagaggaaatttgggtgtggaaaagagactattgcagggagacatgataaggtgggaggtaacattgtacactcaaggagctgaaagatgattagtgtggctggaacacaaataatttgtgtgtgtgcatgttgaggggtaggttgggtggtacaagatgctattggcgaagtcagcagaagcaagcagggactccagcaggcagaccttgcaggccacactaagggttccaggatttcttctaagagcaacaatatgtccttgaagtattgggggtacatgagcatgacattattagagttgcattttcaaaaggtcttctgtgtggaaaatcttttgatgaggagagagaaaagatgtggagagacagagactggcatttggaggcctttgcagaagtctggtaagaaatgatgacagctgggtggttgggatggggagaggatgattgatttgaagatgccaaaaaggacaaggctttaccaacccccctttcaatgatagagagagagaggcaaaatatagatattatcttcataaccggggcccgaaaagtcaaagatcatgcagttagtaagcagaagtagacctggcactggaagctgtctgacctcacatacgctgctctcttttatggcactctgcctttttaggagagaaccttgagtttggagaacttaggtattctctgactgacacagcaccaactacagtgtccagctcttgtgcattaaagctaaatttaggcaatggactcatatctgacaatgagcattgctttgtcaggttcactagataccatttatttatttatttgaggtggagtcttgctgtgttgcccaggctggagtgcagtggtgtgatctcggctcaccgcaacctccgcctccccgattcaagcaattctcctgcctcagcctcctgaggagctgggattacaggcacatgccaccacgcctggctaattttgtatttttagtagagaaggggtttctccatgttggtcaggctgatcttgaactcccgacctcaggtaatccgcctgcctcagcctcccaaagtgctgggattacaggcatgagccaccacacctggcggtagtagtgatttaaatggtatctagtggccgggcacagtggctcatgcctgtaattctagcactttgggaggccgagacaggcagatcacttgaggtcagaagttcgagaccagcctggccaatatggagaaaccccatctctactgagaaaatactaaaaatacgcgcgtggtggcgcgtgcctgtaatcccagctactagggaagctgaggcaggaatctggaaggtgcttgaatctggagggcggaggttgcagtgagccgagattgcgccactgtactccagcttgggcaacaagagtgaaactccatctcaaataataataataacaataataataataacaacaacaacaaataaatcactactaccttctgatgaggagacacactccatcctaactattgggttgtgaataagcttatcagtaaagtcacagtttaccaatctgtttgataatactggtttattgagtccatgatatgttcctagcactctattagttataaaagatacctaaagcacgaccactatagaacttactatctaataggggagaaaagactcaaatacatgattccagcatgacagctcctgtcgtggagatacatgcaggatgctatgggcacccagaggaaggactttgggccgagagttagtcacaggcagatattggtattaatcattatgtggtaatatttcctgaacaagagcataggcgttgtcaggcaaaaatgtctagaaaatactcagttgattaatttgatggaggaaaaataacttctaaggtaaaaatgaaatgtttgtaagttatgaaggttacagtttcaggctgataaggagtttagcaaaattgccttaaacattaattcacttgtggaaataatatgagaaacagagtcttaccatatttttcaactgtgcatgtattttttaatatgtagttatttagtatgatattaatattttgtcagttattatttttctttgaaggtgatttaggcctgggtgaggtggctcacatctgtaatcttagcactttgggaggcttgaggcgggaggattgcttggagctaagagttctagaccagcctggacaataaagctgagaccccatctttacaaaaattagccgggtgtggtgatgcgcacctgcactcccagctactcatgacactgaggctggaggatcgcttaagcccaggaattcaaggttgtatagagctatgattaaaccagtacactccagcctggacaacgtgagaccctgtctcaaaaaaaagaaaaagaaaataatttgggaaaactcactgtaattttaattttaaggggatgctttataataaagcaagaattgcaagataaaagtcacttttcagcaatttgttttacagaagctacattaggacatatctctatctttaagtgaggtgtactcatatatatatttttccctttctgtaatattagttcctcctgggggcaataggaattctttctttctcttttttttttttttttttttttttgagatggagtctcattctgtcacccaggcttgagtgcagtggtgtgatctcagctcactgcaacctctgcctcttggattcaagcaattctcctgcctcaacctcccaagtagctgggactacaggcgcctgccaccatagctggctaatttttgtatttttttagtagagacagagttttactatattggccaggctgggttttttttgaggcggagtctcactctgtcacccaggctggagtgtagtggcgcagtcttggcttactgcaacctccacctcctgtgttcaagtgatcctcctgcctcagcctcctgagtatctgggattacaagcgtgtgccaccatgccctgataatttttgtatttttagtagagacagggtttcaccatgttggccaggctggtttcgaattcttgatctcaagtgatctgcctgctttggcctcccaaagtgctgggattatggggatgagccaccatgcctggctgaaagtatttcttttaagcctgagtcattctgtgggctttgagcacgcttgcatgcttttaaggataacttgccaaactgaatctacctttattttgctgtgtgttttatggttgtctaaaaattttagaaacttttttttttctttttttttttttttacagacaaggtctcactttgttgcccaggctggggtgcagtggtctgatcctagctcaccgcaatattgaccttctgggctctagcagtcctcccacctcagcctcttgagtagctggcactataggtgtgtgccgccatgcctggctaattttttttttttttgagacaggaatttcgctcttgttgcccaggctggagtgcaatggcacaatctcggctcactgcaacctctgcctcctaggttcaagctattctcctgcctcagcctcccgaggagctgggatcacaggcatgcgccaccacacccggctaattttgtatttttagtagagacagggtttctccatgttggtcaggctggtctcgagctcccgacctcagttgatccacccacctcggcctcccaaagttctgggatcacaggcgtgagccaccacgcccggccaattttttaaattttttgggagagtcagagtctttgctataatgtccaggcttgtcttgaactcctgggctcaaacagtcgtcctgccttggcctcccaaagggctgggattataggcgtgagccaccacgctggccagaaactgattttaataatattttaaaaatgttaaatgatgggggccgggcgcagtggctcacgcctgtaatcccagcactttaggaggccaagactggcggatcatgaggtcaggaaatcgagaccatcctggttaacatggtgaaaccccgtctctactaacaatatgaaaaattggctgggcgtggtggcgggtgcctgtagtcccagctactcgggaagctgagccaggagaatggcatgaacctgggaggcggagcttgcagtgagccgagattgcaccactgcactccagcctgggtgacagagtgagactccgtctcaaaaacaaaaacaaacaaacaaaagttaaatgatgacatagtgagaccctgtctctaccaaaaaaaaaaaaaaaaagttaaatggataccctttcacataagtctgtttaaattcattagttggggcactggggaacattggagcttgttttcctgaggaacccgagtgttgggggcaacctagtattccaccccatctggtagaagctctataggatgtgttacgtaggtctcttaaatatatcaatgcaactgtgactaaaaagtagttctgcttcagtacttgaatagaagtccttgatggttctgggctggaaacatatagggtgtgctaataaggttggtaagaactctgtatgttggtgatgtcattgtgaagtcagttggtatatttattgcagggaaacttggaattatttcctactgatgagtgtaaaggagaaaatataatttggcatttgttgaactacttaaccattctcttaagccagttttactaagctttaaaatgtcagtattgcacctgttatattatgaaactttatggacatgacttgagatttctcagtgaagaattacaggaaataaaattttaaaaaatcaaaagtgctggtttcagtttttatttagattgttacttaaaacttataatctagcacaatgggagagttttcaggtgataataattgtagcttcatttatttatttattgagatggagtctcactctgtcgcccaggctggagtgcagtgatgcgacctcggcttgctgcaacctctgcctcctgggttcaagcagttctcctgcctcagcctcctgagtagctgggattacaggtgcccgccactacacctggctaatttttttgtatttttagtagagacacggtttcaccatgtaggctaggctggttttgaactcctgaagacctcaagtgatccacctgcctcggcctcccaaagtgctaggattacaggcatgagccactgtgcccggcctatttatttatttttaaagatgagatctcattctgtcatccaggctggagtgcactggcttgatctcagctcactacagtgtccaccttcagggctcaagcgatcctcccacctcagcctgctgagtagctgcgaccacaggcacgtgccaccatgtctggctaattttctgtatttctggtagagactgggttttgtcatgctggctaggctggtctctagctcctaaactcaggcaatccacctgccttgacctcccaaaatgctgggattacaggcatgagccactgtgcctggcctaattgtagctctatgtattattgactatatgcgaggtactgtgctatttaattttacctaacaacagcccagtgaagcccaatgagtaaattattagttccaatttataagtcaggaaaccaaagctcagaaaggccaaatcacttgctcaaggttactttgtgagtaagtggcatagtaagaattgaaccccagactgctcaaagacaccaaaccactgtgctattttctatgtaacattgtatttttcttttcttttcttttctttttttttttttttttgagacagggtttccctctgtcatcaggaggctggagtgcagtggtgtgattatagctcactttagcctcgacctcctgggctcaagcaatcctcctgcctcagcttcctgagtagctgggaccacaggcacacagcaccatgcctggctcattctttgtatttttggggtctcactatgtggcttgggctgtatcgaacttctggactcaactgattctcccactttggtctcccaaaatgctgggaatacaggcatgagacaccgtgcctggcctgtatttttcaatagtcatatttaataaaatttttaaaggcataattcaattaataaatgtaagatgatgagggacctgatacagtttcacctttcatgtttcctatgacatctcttcagaagcgtttgttgagccactgtatgcagtgcacaatgctgctaggcatttgtggacaatgcaaagatgatgacatcttggcctcctgggtgatccaggaatttacagcaatgcaatccaggtccaggaatttacaatccaggaattttcggggagaaagacattgccagtaatttttggataagctggttcttctggatagataaaaggacattgttaagaaccacttgctggctggaggtggggacttcaaggggacttcattttttgagaaggaccttaaaaggtggtaagattgggatctcttcaaggaaaactacaaaccactgctcaatgaaataaaagaggacacaaatagaagaacattccatgctcatggataggaagaatcaatatcgtgaaaatggcgatactgcccaaggtaatttatagattcgatgccatccccatcaagctaccaatgactttcttcacagaattgaaaaaactactttaaagttcatatggaaccaaaaaagggcccgtgttgccaagacagtcctaagcaaaaagaacaaagctggaggcgtcacactacctgacttcaaactatgctacaaggctacagtaaccaaaacagcatggtactggtgccaaaacagaggtatagaccaatggaacagaacagaggcctcagaaataacaccacacatctacaaccatctgatctttgacaaacctgacaaaagcaagaaatggggaagggattccctatttaataaatggtgctgggaaaactggctagccatatgtagaaagctgaaactggatcccttacaccttatacaaaaattaattcaaggtggattaaagacttaaatgttagacctaaaaccataaaaaccctagaagaaaacctacgcagtaccattcaggatataggcatgggcaagaacttcatgactaaaacaccaaaagcaatggcaacaaaagccaaaactgacaaatgggatctaattaaactaaagagcttctgcacagccaaagaaactaccatcagagtgaacaggcaacctacagaatgggagaaaatttttgcaatctacccatctgacaaagggctaatatccagaatctacaaagaacttaaacaaatttacaagaaaaaaacaaacaaccccatcaaaaagtgggcaaaggatatgaacagacacttctcaaaagaagacatttatgcagccaacagacacatgaaaaaatgctcatcatcactggtcatcagagaaatgcaaatcaaaaccacaatgagataccatctcaaaccagttagaatggtgatcattaaaaagtcaggaaacaggccaggagcgttggctcacgcctgtaatcccagcactttgggaggctggggcaggtggatcacgaggtcagttcaagaccagcctgaccaacatggtgaaaccccatctctattaaaaatacagaagttaggccaggcatggtggctcacgcctgtaatcccagcactttgggaggctgaggcgggcggatcaccaggtcaggagatcgagaccatcctggctaacacggtgaaactccgtctctactaaaaatagaaaaaaattagccgggcgtggtggcgggcgcctgtagtcccagctgctcgggaggctgaggcaggagaatggcgtgaacccaggaggcggagcctgcagtgagctgaaatcgcgccacttcactccagcctgggcaataagagcaagattccatctcaaaaaaaaaaaaaaaaaaaagtcaggaaacaacagatgctggagaggatgtggagaaataggaacgcttttacactgttggtgcgagtgtaaactagttcaactattgtggaagacagtgtggtgattcctcaaggatctgtaactagaaataccgtttgacccagcaatcccattactggatatatacccaaaggattataaatcatgctactataaagacacgtgcacacgtatgtttattgtggcactattcacaatagcaaagacttggaaccaacccaaatgttcatcaatgatagaccggataaagaaaatgtggcacatatacaccatcgaatactgtgcagccataaaaaaggatgagtgcatgtcctttgcagggacgtggatgaagctggaaaccatcattctgagcaaactatcacaagcacagaaaaccaaacactgcatgttctcactcataggtgggaattgaacaatgagaacacttggacacagggcggggaacaacacacactggggcctgtcatgtggtggggggcagggggagggatagcattgggagaaatacctaatgtaaatacctaatgtaaacgacgagttaatgggtgtagcaaaccaacatggcacatgtatacctatgtaacaaacctgcacgttgtgcacgtgtaccctagaacttaaaagtatagtaataataataatttttttaaaaaagatggtaagattggctgggcacggtggctcatgcctgtaatcccagcactttgggaggctgaggcaggcagatcacttgaggtcaggagttcgaaaccagcctggccaacatggtgaaaccccgtctctactaaaaataccaaaaaaattagccaggcatggtggcaggtgcctgtaatcccagctacttgggaggctgaggcaggagaatcgccttgtacctgggaggcggaggttgcagtgagccgagattgcaccactgcactccagcctgggcaacagagcgagactccgtctcaaaaaaataataataaataaaaaagatgataagatttcagctggtggagataggactaggagaggccatttctccttgaggggatgggaaagcaaaggtgaagatgagagaacaatgggagtggggctggaaacgtaaattggtttagaagggaaagtttttgagtgctaggataagtgatttgaactctatgcactaggtaattacattttcattaacatttatcaagaatctattaagctaagtcactgtttttaatgttaagaaatcaaagaattgtttttatagttgtccgacttttcaccaaagacagcacctttcataacctttatctcaggattccttccacgtccaaggtcctgacttttgtccttggaattaagccctaataggagagaaccatctttttaagacattgactgatttctctgtttaattttgatgcagtttaacaccatctaatataatctgccattttgagctatgttaggctggtagatcgcttacctgggcattacttgtttgcttctctggaatccttaaaaggatcacaatatagaatatagtactaaagggcagttgctgtgggagagttggaagtgctgagttgtgggatatttcagaagctctactttttcttttttctttgagatggagttttgctcttgtcgcccaggctggagtgcagtggcacgatcttggctcactgcaacctccgcctcctgggttcaagcgattttcctgcctcagcatcctgagtagctgggattacaggcatgtgccaccacacccggctaattttgtatttttagtagagacggggtttctccatgttggtcaggctgatctcgaactcccgacctcaggtgatccgcccgccttagcctcccaaagtgctgggattacaggtgtgagccactgcgcccggcctgagccactgcacctggcctgttttttctaactgtgttgaataatttgggattcctctctacccttagtttcaaaaagcaatattgtgcagaaagcaaatgaagtcaagtgaatatgatttgaagttggacggtttttggtatgtcttcatcttttaaaaccatcctcttttccaatataaactgttgagtctgaattgacttgttctgaattcaagcaacttgttttttttttttttttttttttttttttttgagatggagtctcatctgtcacccaggctggagtgcagtggcgtgatcttggcttgctgcaacctccgcctcccaggttcaggcgattctcctgcctcagcctcctgagtagctgggattacaggtgcatgccaccacgcccagctaatttttgtatttttaatagagacggggtttcactatattgccaggctgatctcaaactcctgatctcaggtgatctacatgccttggcctcccaaagtgctgggattataggtgtgagccactgtgcctggccttgtatttgtttttaatcaactaggactttgtgctttggtttgtgatagctatttcagtttggtgctttaaaaaaccctcttttaaatgatggccagaagttagtgggtgctttcagattgtgaggcaggatagttatccaggttttggcagtttcaagtgagatcattttattttatttattattcttattttttgagacagggtcttgctgtgtcacccaggctggagttaagtggcacagtcatggctcactgcagcctcaacctcctgggctcaagtggtccttctgcctcagcctcacgactagctgggatcaccacacctggctaatttttgtattttttgtagagatgaggttttaccatgttgcctaggctggtctcaaactcctgggctcaagcgatcacccgccttagtctcccaaagtgctgattacaggcctcggccactgtgcctggctcattttatttattatatgccacatttacccatataactacacgtgaaaagtgaaccgagtacttctattcaggagggattctcaagctttttgtagaagagtaaatggtgttgtgcttgtaacccaggaagctgcagtctgtatctggtctatatctggaatatttgctgtagttaacactctcagtctggttgttattgaagacaatgcaaatgtcccattctcagtaaaagtgtgagccttgatatcagacatctggctttgaattctggctcctttgcttaatagctgcataacaccaggaaagttactttagcttatctgtaagcctcagcttcctcatctttttgtttgtttgctttagagacagggtcttgctctgtcacccaagctggggtgcagtgatgtgaacatggctgactgcagccttgaacttctgggctcaaggaatcctcctgcagtggcttcccagtgtgctaggattacaggcatgcgccactgcagctggccagcttcctcatctttaaaatgagaatagtggctgggtgtggtggctcacacctgtaatcccagcactttgggaggccaaggagggtggattacgaggtcaggagatcgaaaccatcctggctaacatggtgaaaccccgtctctactaaaaatacaaaaaattagccgggcatggtggcaggcacctgtagtcccagctactcaggagactgaggcaggaaaatggtgtgaacccgggaggtggagcttgcagtgagccgagatcacaccaccccactccaacctgggcgacagagcaagactctgtctcaaaaaaataaaaaataaataaataaataaataaataaaatgagaatagtaataatctctcctagggtcatgaaagggcgaaatgaaataatccatgtgaagagctcagcacagtgcctgacgcatgctacgtgcccaggaaaagtagtttttgaaaaacgctgattttctatttgcactttattgaaaacttggtggatgctttgaatactgagaatttcattaccactttttcagttctaatgtgcatactgttgtacactggtacctactgtgcagatcatgactgaaaggtgtttgaaaggacagtattgtgaaatcttttgtcattacgttaatgttattgcaataaaataacaaatttttaactattaaaagtaatgccatctgtttttcttcatctgtgttttcaccacaaagagataaaactactgttgacattttgacatatcttttttcctccagtgcgtatttatttatctttttaaaatttatttttaacataattgagattacaccgggttgtaatttttgttatgtcttaaattcaacagaattttattttattactttactttgttttttgagacaagacctcactttgttgcctatgctggagtgcagtggcgtgtgatcatggctcactgtggccttgacctcccaggctcaagctatcctcccgcctcagcctcccgagtagctgagactgtaggtatgtgccaccatacctggctttttttttttttttttttttgagatggagtcctgctccgtcgcccaggtggagcgcagtggcatgatcttggcttactacaacctccgcctcctgagttcaagtgattctctgtttttttttttttgagacagagtttcgctcttgttgtccaggctggagtgcaatggtgagatcttggctcactccaacctccggtttctcttgcctcagcctcccaagtagctgggattacaggcacgcaccaccacacctagctaatttttgtatcttcagtagatacggggtttcaccgtgttggccaggctggtcttgaactcctgacctcaagtgatccagccgcctcagcctcccaaagtgctgggattacaggtgtgagccaccatacctggttcaacagaattttaaataaggctgcacagaaatatcccatcagatggatcttacctctgcgttgtcattctccatcaaataatgtaacctaaaccagataacaccatgctctggtaatgtatcgttgagtaatttgattctgctgtcttaactgatacttaagccttcatcatgagccaagagatagctctcatttatgagatgaagctgagaatatgaaaagaaagaggatttacttatgctcaaaaatttactctatttttggcaatgctcaggctatttctctagtaattcacttgaagcacatgtcttatagaaataaatatttacatttttacagaggaagaaattaatgaaatgcttttcctgtaaaatggggaattttacattgtttttggctactagatttaatatagtgtgactagcttagcattttaattataaaatttcaaaattaggttaaattatgtgaaactcttgttttgaaaatatcactctttctttgcagtagttaatctgagaatagtcaaatggattttgtcatggtgtaggataaggtcacttagaaccagctgaaaattttacaaagttttaaaaaaggaggctgggtgcagtggctcacacctgtaatcccagcagtttgagaggctgaggcaggaggatcacatgagcccagaagtttgagaccagcctgggcaacaaagcgatactccaatctctaaaaacattaaattaaatattaaaaaaaaataagaaaggttgtctaacgatacttataaaaaacaaacttatgacttgaaataaggcacttactttttttaaaatgaagaaaaattctaccttggtaataagagaagtgcaaattaaaacagcaagataccagcttttgtgtaacaaattagcaaaaaaaaaattttaatggtaaaattcagtgttgaaatgaggacacatggacaaagggtggggaacaacacacactggggcctgtcccggggggtggtggggtagggagagcatcaggatacatagctaatgcatgcggggcttaatatctaaggtgatgggttgatttgtgcagcaaaccaccatggcacaagtttacctgtgtaaccaacctgcacatcctgcacatatatcctggaaacgtaaaataaaattaaatttaaaaaatgattaaagaaacattcagcattgacctgggtatgaggaggtgggtgctatcactgtgagtgggaattgacacaccctttctggtaaatgcttttgtttgggattcttgtgattatactcctagtagtcaactttcctgagggcatggtctaactcagacacagagacatttatcaaagcattattcatactagaaaaatagcagaaacaattcaaatgttcaacaaaaggagaatagttaagtcaatttcaacatatccaaataatgaaatattacatagctattaaataatgctttcaaagcataattaacaacttgggagaattctcacaatatgatatactgtgtgtgtgtgtgtgtgtgtgtgtgtgtgtgtgtgtgtgtattgtagtatacctattttaccatcaatatctttgcatagaataatttttaaaagactaaggagaaacaaaatgtgctttcagatttttccaaaatttcttccgtgagcatttatcctataatcagaaagaagtgaataaacattagtgtaaaataatgattttaaacaaatggccatggtagttcacttcaaatggctggagttttactgtatggatcacaacatattgtacttaatggaaaaactattactaggagccattcattttttaaaatgacacattatgtgtaggtacattttcacatttagatgggcaaaattaagtcctgagagcttgcatctgaaatcatatggccaatcagtttaagcgaactctaaacttctttgatgagaactttggcacaatttcatcaattctaggaaaacacttctgcagtacttaataagtgatatgagtaagtaaaatgggaagaggactaagtaagtagttccaaaaagagaaaccttttaaaaatggaaaaaggacaaacttccctgtccttgacttcttccccttcaccaccaccccctttccttggcctaactggaacgcacagtcacattaagtgatgccttgccctttgactgactctctcagtaaaagttcagatagccatctagtggaaagaagactctttaagaatgactttcctccagacacccaatatcatgtttgttcagttggcttgtccaaacaatttttctgtgttttcaccagagtagtatcaacttagcatgaagattaaagctgttctccatctgctttatctgccgttcttaattagaacctgatgacagaaatcaactttgattcaaggctgattgttcccggagaatctcattattattgtaaacagtttttatttttctttctttttttttattaaacacattgattctgagcatctatatggcagaagtgagggtaaaaaaataattttcttcatttaatcgtgtattcagcatctgctctgctagatgccgtggggcatattgaagttgcttaaagtctggtagagaagataaagcatgcacagaaatagtttttaatacaaacttgaggtgataagtgcccaaagggacaggcacaatgtatgtggaaattcagaggagcagttatttctcgttaaggaatcgtgttttctgagttttcttttagaaattaaacagatgtgcattgttctgatggactgaaaaaaagagaaacaaatggtcccttgctttcacactttattttactttatgagaaattaagaggcaaatgtttgtatatcaatcccttaggcaagtaatggactttagagtgccttaatggttttcaaaaaatagtctacaaatattaagtctacactcagagtctgcagtctaccaactttaatgaaatgtaattttatgcataacataaagtaatattaaaaattacttgtagaaatagttaattgggctaattagatattctttttttttttttctttgagatggagtcttgctgagtcacccaggctggagtgcagtggcaccatctcggctcactgcagcctccacctcccaggttcaagtgattctcctgtctcaggctcccgagtagctgggactacaggtgtgtgccaccacatctagcttatttttgtatttttagtggagacagggtttcactgtgttggccaggctgatcttaaactcctgaccttaagtgattcacccgcttcggcctccgaaagagctggggtcacactcatgagccactgcgcctggctagatattcttaatgggcaaattgggagcctagtcttggcatcaggtgtcctgtatttaatcagttggcagagctagttacctggaccacctactcagcctaggaggtgctgtgatacagcagagaagacataaacttgggctctgctacttggtagctttgggccttggtaagttttactttgtctttctattccttggtcttctcatctttaaaacacctcctaggattcttgttaggattaaatgaaatactatatgttgctttgatttgagtggatcccctccaaaattaacctgttgaaacttaatggctaacgtgatagtgttaagcgagggggttgcctttaagagggagttaaggccatgagggcttctccctcatgaaagtgattgaagccctcataaaagaggcttcactcagcacttggccctcctactcttctgccctctgcggtgtgaagacacagcgttcctcccctccagaggatgcaaggcgccatcttggaggcagagaccgtgcccctcaccagacactcagcctgcccgcgccttgatcttagacttcccagcctccagaactgtgagaaataaatttctcttctttacaaattacccattctgtggtattctgctatagcagtacaaactgaccaagacatatatgaagcacctgacacacagctctctataaataatgcttcttccctgctctgtcttgacttgtttgaaggatcagcagttaacaatgaacagtttaaaatgatctcagtattctttctttttcctcttgagggtgaacctcttaaattgggctggcttatagttcctaaaatcacagctgtttgatatagacgggggattatttgaaagtctgagtcaaagacgagaagtaggaaatcagtttttccccggctgtcgttgtgcgcctccttccaggggagtaatcagctcagactatctcaatagttaatacttgctgttctactcaaaattgaactcactaaaatctcagtgatttcttcattgaagattgccagtagatggcttttaattccctgtagtgtctgctttactgttttcatgcttgtttttctaaagtcttgagtcagcgtctttatccttatcagtgtttggcctttgtctactctatctctgtaaatcatttgtaggagggttaaattccatctgacgcaaattgtgattttaaaaataaattgctttgtcctaccatctctgaaaataaaagcagataattttcctaagtcacttatttaagaagtagcacaagctaaatgccaaccacttgaagttgtagacttgctagacttttttaagcttcaaggtctctgtgttttctgtttcaggtaaaaatggtcaggactaaacagttcttcaggggaaaaaaaaaatagggtctttgtcacagctgagtcttcatcttaaccaagatttttgccagaaagcctttccttctcttggaattttatgctggttgaaatttgggtttagttgaagtataaggagctgtatttccttatgtctggttaagttccactgtcttttccacttgcagattttatattcagttgtcaaatttgcttgtgctcagcattgaacgtgatttctgtacttgtatgattaaactggaaaaatctggaataaataaactggaataaataaactagaactgttttctgaaattggaagggatttagataatggtttgatggatggaggaggagtgaaaggtgggttagtatgaattttaaaagtttagatttttgccactgttcatgctaatgtaaaaaaggatcttgttggcctggcgtgtggctcatgcctgtaatcccagcactttgggaggctgaggtgggcagacatctgaggtcaggagtttgaggccagcctggccaacatggcgaaaccccatctctactaaatatacaaaacagccgggctgggtggcaggcacctgtaatcctagctactcaggaggcttaggcaggagaattgcttgaacctgggagacggaggctgcagtgagtcgagatcgcaccattgcactccagcctgggcaacagagcgtggactccatcccaacctaaaaggatcttgtttaaatggtgcctattccctgtagattttgtagcttggtattacaaatatttatttagtgcctgctatatgtaggatgtaatataaaatagattaataacatggtcctttcctcaaggaattgtcatggaattaggaggtgggaataaaggagacgaagatacatgtgctgagtgcaaagctcagggaagattgaaaatatgcagtctccttgggagtgaggtgggatgaggagtggggcaggatataaatgaagtttctaggaggaggtacttaattaaggcacagaatcatggaagtgtctggaagaatgcagagagctatgagcaatctggtaggtccatggggctacctggggtctggtgtgatccagctcactttagcctcgaatttctgggctcagaggatcctcccatgtcagcctccccagtatctgggattacaggtgcatgccaacatacttcgctacgttttttaaaaaatttcttttagagataggggtcttgctgtgttgcccaggatggtcttgaactcctggccacaaacagtcctcccacctcagcctcctgagtagctgggattataggtgggagccactgtgcctggcctcctttctcctcctaaactggttttattgaggtataatttacataccataaaacccacccatgtaagcatacaatccagtgatttgtaaaagtaaatttatagagttgggaattgccacctcaacccagttttagaacactgctttgtccctggaagtttcctttcttctgggtcaatccctgctttcatctccagcctctggcaaacactgttatgctttctgtctctatagatttgacttttctagaaatttcctataaaaggaatcataggtagtcttttttgtttggctactttcacttagcaaaatgtttttgaggctcagccatggtgtagcatgtataagttgtttgttcctttatgccgattaattgtatttgattgcatggatataccacattctgttacccatttgctagttgatgggcatttgtattgtgtccaggtttaggctgttattaataacgctccaaggctgggcgcgggagctcatgcctgtaatcccagcactttggggggccgaggcgggcggatcacctgaggtcaggagttcctgcccagactggccaacatggtgaaaccccgtctctactaaaaatacaaagttagccaggcatggtggcaagtgcctgtaatcccagctacgtgggaggctgaggcaggagaatcgcttgaacctgggaggcggaggtggcaatgagctgagattgtgtcactgtgctccagcctgagcgacacagtgagactctgtctcaaaataataattccctgtgggcacttgcatgaagtctttgtgtggacatgttttcatttctcttgtggagatacttaagagtgaagtttctgggtcatatagtaagaatatatatatattttacttttcaagaagctgccaaactgttctccaacttggctgtatgtaccattttacaaccagcaatgtctgagggttttggtttttccacatctttttgttgttgttgttgttgttgttttgttttgtttttgtttgagacggagtctggctctgtcacctaggctggagtgcaatggcgcaatctcggctgactgtaacctctgcctcctgggttcaagtgattctcctgccttagcctcccaagtagctgggactacaggtgcccagcaccaagcccggctaatttttgtatttttagtagagacagggtttcaccatattgaccaggcttgtctcgaactcctaaccttgtgatctgcccgccttggcctcccaaagtgctgggattacagatgtgagccacccaacctggttattttccacatctttgtcaacacttggcatgtgagttataaccatgctactgggagtgtagtgcttttttttttttttctttgagacagggtcttgctctgcctcaggctggtcagtggtgcgattatagctcattgcaaccttgacctctgtggctcaagtgatccttccgcctcattgcactgagtagctgggactacatacaggtgcacgccaccatgccaggctaatttttttgtagagacagcatctgactatgttgcctagtctggtctcaaactcctgggctcaagcaatattcttgccttggcttctcaaagtgctggggttacaggcatgagccacttgtgcccagccagtgctgtctttttttttttttttttttttgagacagggtctcactctgtcacccaggctagaatgcagtggaatgatcttggcttactgcagtctccacctcctgggctcaagtaatcctcccacttaaactttccgagtagctgggattacaggtgtgcaccaccatgcctggctaattttttctattttttgtagagacagggatttgccatgttgtccaggctagttttgaactcctgggctcaagtgatatgcccacctcagcctcccaaagtgctgggactacaggcatgagccactgcactgcgcctagtagtgcttttttttgaggcggagtctcgccctgtcgcccaggttggagtgcaatggggcaatctcaactcactgaaatctccgcctctggggttcaaacgattctcctgcctcagcctcccgagtagctagaattacaggtgcctgccaccacgcctagctaatttttgtatttttagtagggacggggtttcaccatgttggccaggctggtctcgaactcgtgaccttgtgatttgcccgcctcggcctcccaaagtgctgggattacaggcgtgagccaccatgcccagccagtagtgctatcttagttgtagttttgctttgtatttctccaccgactggcagtcttttaatattgtaaattatttcggctatttcagaaaacactactctataatagcggcaattggtgttgtggttcactgttttgtttgttttcttgaggcggagttttgctctttgttgcccaggctggagtgcagtgttgcgatctcagctcaccgcaacctctgcctctgggttcaagtgattctcctgcctcagcctcccgagtagctgggattacaggcgtgcaccaccacgcctggctaattttgtatttttagtggagacggggtttctccatgttggtcaggctggtctcaagctcctgacctcaggtgatccgcccacctcggcctcccaaagtgctgggattacaggtatgagccaccgtgcctgccttattaactgtatttttttctaaagctcttgaaagaatttttgtatgtgaagaatccagacactattttattagagactctttgcttacttatttttactctttctttttgagatttgtaaaattatcctctgatataaactacctgtggcctgccacctgcttttgtatgccccaggagtaaagaattttatttttaaatggtcgaaagtaaaagaatactattttagccaggtgtggtggtgcatacttatggtcccagctacttgggaggttgaggtgggaggattgtttgagctgaggagtttgaggctgcagtagccatgattgtgcccctgcactccagtctgggcaacagcatgaaatgctgtcttgaaaataattgtgatatgtgaaaattacatgaaattcaaatttcagtgtcataaataaattttgattggaatacagccatgcctattcatttatgtgttacccatgtctgcttttgtgctataagggcaagagtagggtagtttcagtagagactgtacagcctgcgtagcctaaaatacttactgcctggctctttacagaaagtttgcccaccctggctctcacccattccagatgttgcctattctcagaaaaaaatttgctattgacttgtccttttggttcagttccttttttagagatagggtctcacaatgttgcccaggctgaagtagagtggctgttcacaggcacagtaccagtactgatcagcatgggaattttgacctgctctgtttcctccctgggccagttcaccccccttcttcaggcattggttcagttcttgtgttggttctccagtttgttgttactgggaaacctgaattcatttctcaagtgtcaccctggaagggaagagacttattgaaagattcctgttttgtaatgtgttctttcctggcttggtgactctagttaaagttagtctctggggcttggtgtggtggctcatgcctataatcccaacactttgggaggccaaggtaggataatcatgtgagcccaggagtttgagaccagcctggacaagatggtgagaccctgtctctacaaaaaaaaaaaaaatctaaaaattagctggtcctggtggcacttgcctctagtcctggttactcagtaggctgaggtgggaggatcccttgagcccaggagttcaaggctgcagtgagctatgattgtgccatttacacaatccagcctgggtgacagagtgagaccccatcctttttttttttctgcaaacactatggtgacttagagacctcgtccctaaaaaaaaaaaaaagaaaaaaaaaaaagtctctgggaccttttaagaaagtcacccagtaaacaaaggggaaagaatggtgcttttgtagatgaaggtatcacgttaactatttgtgtttggaaagtgatgctgtgtaacatagataattttgtttattggtttttttaagtgcccattataaaatttaagataatacagaggtataggaagtcacttaccccctcattctactcttacttgtcgccattattaggaatttatttccttttatacctttttctatgcagatataaacatagccagttgggttttgtggctgtttttttcagaaatgaaactgcagtgtacattttgttttaaaatgaaggtttttcagaacttggcccagggtatggtggctgtgcatacctgtagatttgctgtcttcattttagcagctgcatggcctttttttgtatgactctaccataatctacttaactgttgatgaagtttaaggtttttgcttatgtaagtaatgtccgtgtgtttcagttggccttactaacactggttatattcatctttaacatatttttctttttttggcctatttggtaagtgaaaaatagctcattgtcataacttgcacttcttcagtgagactgaacattttccttattttagccacttgtacttctatgaattatctattgcttatttttctttgggttgtttgtgtcttttaattggttgcagatctttatatattataaaccctaactcttaatttgcaaatatttcttacaattgatcgtttcttatttatggtggcgtttttccttacagaagtcttagttttgtatgttgtcagatctgtcaaacatttatagctcttggatttggaggtatgcttgcaacgtgtttccatgttttaatattctaagtgtaactatcttaattcagtgattcctaatcatgactgcatcagaataatttaggggaatttttttcagcatatatgctgtgatttccaactaagatattctttcttcgtagataaaatgtggggtccaaatctgtggagtttggtttgttttgttttggagagaggaagaagcttcctggccaggcacggtggctcatacctgtaatcccagcactttgggaggccgaggcaggcgaatcacgaggtcaggagatcaagaccatcctggctaacatggtgaaaccctgtctctactaaaaatacaaaaaaattagacgggcgtggtggcgggcgcctgtagtcccagctactcgggaggctgaggcaggagaaggcgtgaacccgggcggcggagcttgcagtgagctgagatcgcgcctctgcactccagcctgggagacagagcgagactgtctcaaaataaaaaaagctccctgattctgatgtgaaaccctagttaaaaaatcacagtatgtaaaacagatttcattgcctctttccagttgagttgtgtttttttctttgagagtgtgaagggggtggtgctgcttggttccttttacttaacattcattgagttcctgtgacacacttggagaattagtaaggagagaattcatgcaactgataaggagagaaactgctgtacattgtaccctttgctgtgcactgtaactgtacaatcaagtttctttatcttgacaattgtgttaaaccacaagctattggctatatttcattggttgaaagatgcactttttttccccacgttttaacatccatgaaactgggatgacagcatgacatagtttatttggcagcattttaaattttgtagtataatggttcatcttagtcaacttggagaagttggataattttttatctttcatttttgtatctaaagtacatcagtacggtttttttttttccatactggccttcatgttcctgagtggtctcttctcttctagtgtttctttccttctaattaagttttatatactgctgccagattaatcttcccagaccatgattctgattaaatcactgctatatgcaataactttttttttttgagctagggtctcgctctgttgcccagactggaatacagtggtgcaattatggctcattggagcctcagcctcccaggctcaagtgatctcctacttctcagcctccagagtagctggaactactacaggcaaatgccaccacactcagctaatgtgtgcaatgtgagcctaaaatacactaaaacatgcatgcttgtgctaattttctgtgtgtgtgtgtgtgttttttttttttttggtagagacaaggtcttactatgttgtgcccccaggctggtcttaaactcctgggctcaagagatccacccaccttggcttcccagagtactgggattacaggcatgagccactgtgcctggccttatgcagtgacttttaataagaaacaactgtaacagaaagttcaaacattttaatatttcattttagaccctttgaatgaaatatttacctcttcaaccttttattcttcacatactccaattttgcattgataagctaacagcatcttttcatgtattcccccccccccttttttaaaacaacatcatcttgtatttacttattgaatccttatgcgggattgctccctaccctctccccagacctctggctgtttgaaacccacctatcctttctgctcagcttctgtcattcatccatctccatgcaattgctgctggtataacaggggtgaaagataactattgacaaagaacagggaagtttttttggaactctggggttttaagaaaggcattgacgtccttgggaactaggtaatacagtttcctctccttttcctatttttgattttggctttggctttgtatttgaaattctcttcttcacttcagatggaggtgtgggaggggatgtgtggggtgtagtatgtgtggccccacaggtagatcacctgatcagtcttttaccctaaacataagagagggaaaagcacaaaaaacaacagctctaagatggggcatgtacatgtccaaatttgaactcagtcatgtttttgtcaaactaagatgatgaactagttataagatgaagtttgactggacgaatgtagatcctattttgaccataaagctagttgcataagtaagcacaggatgatgttgaggggtttgtggcttaggagtagcacttaaggacatctgcggagggccaaatgtgagtccgtagtgagatgtggcaacaacaaaaataaaatctcagatgcattattgaaagaaaaaaagaatatctagaattgggggagatgataatcctatttatttttttttttgagacagggtcttgccctgtagcccaggctggagtgcagtggtatgatcacagctcacttcagccctgccagtagctgggactgtgggtacacactactgtgcctggccaacttttaaaatttttttcatacaggcagggtctcaccatcgagcccaggctggtcttgaactcctgggctcaagcagtcctcccgccttggcctcccaaagtgctgggattataggtatgagccagcatgcccatgaatcctattttattctgtattggggtggacacaactatcaagtcttggtcaattctggggcacacattttgaaattagaagccacatacagaagaacaattgaagaaagatctgctttggagacatgagaacttggggcatgggaagcccataattagccatcaggatatgtaaaggaagaggatttgtaccttgtggttctagggaatagaactaaggccagtggatggaagccacagatagaaagacatggctcaatttaaagactaatttgcagtgagagctgtttaatgatggagtagaagatggtaaacttcctgtttgtaggaggttgaacaatcatttggcagctgtgttttagaggatataaaaatgttgaatcactaacaagtgttcacttttcctcattataaatggaaaaggcaagaaacactcaaaatttaaattggcactcataatatactatcatgacataacatgttatcaaatttattattttgcaactgacagtaatcacttagccagcagatgtacttcagccttagcattgaattaagcagagtggtgacagtgaactggatggtgaatttgctctagcaagtttacctgagtggattctgtgggatggaattagaaaaaaaaaaaaaaaaaaacaaacctccacagagttaaacagccttttctcatcagtgatacagtggtaagaacctgcaaatacatgtatgtacactgagagggcaggaggaactttatgccaaggtcttcataagcccaaattaacaaattgccaagtatgtcaaaacttgtgtctgtgttggcaggacctgtgaagcactcctctggaacatagtctgcaaaccacaacactaagtgattgatctctaaggcctccttccaattgtaaaattctttggtaaatgaccttgtaatatatgcttggcagtagtttagggttatggagtaacagaagcatagccaattaaaactatgagaaaacttaggtgtattataattggcccctctggaatttggccccagctttgaggatcataattacaacgaagtcagcagtttgaaataagttttcaccataggggagaagagactcagtggcactacggcttgctttcagtcttaagtgaaattctacttccttgtcttaaaagaacctcactggttctttcaattgagaaaccttgatggtttgaaagagatacttggaagagagtgattaatgaaaataatattggtgtgtataaagtcattgagcagctgaggggcttagaagctgagaagatctgaaagcaatgtgagcctaaaatacactaaaacatgcatgcttgtgctaattttctgtcaaatttacaaaatctttggagggagagtggaatttagaagagaaagcaaagtgaataacattttatgattaatgaaagaagaatttagtagagtagtgcagaattgaagccctaggcagattctgaattatcctttgtttcagggttctctgaaccctcaaggctgggttaggtgcccaccttggtactgtgtaacattatgtctgttacagtatcagttccaattcttgccttttttttttttttttttttttttttgagatggaatcttgctctgtcacccaggctggagtgcaggggtgtgattgcagcttagattgcagcttactgcaacctccgccttctgggttcaagcagttcccttgcctcaccctcatgagtagctggaattacaggtgtgcgccacacgcccaggtaattttttttttttttttttttttttttttgtatttttagtagagacagggttttaccatgttgaccaggctggtcttgaactcctgacctgaagtgatttgtccaccttggcctcccaaagtgctgggattacaggcgtgagccactgcgcttgccctgtccactactttctaattggttgttttcaaactctctgagcttcaggaagacaaggaccatgtttggactctcagggttggatgtacgttaagggtttaataaatgtttgttgaatgaataaacaggaacccctttacctttctttcatttatgctacttccttgttttggcatttctgagatattgctgttaacatcatgcagcttgactattaacactttacctttatgtgctgataattggtcaagttgggtattgggtacagggaggctcacagtattattcttcccataataaaaagagttttagaaaagacattaacatctgtaaaactgattgtcctaaagagctattcccatctgactgcagagtggaaagcatctgatggcccaattgtgacaagctcttattatttactctcatggatgtttgtacaggttgcgtattccttgtatgtatgtttgggaacaagcattttggatttttttttaaaggttttggtatatttgcattatgtttactggctgagcatctgaaatccaaaaatccaaaatctgaaatgctccagtgaacatttcttctgagcatcatgtcagtgctcaaaaagttttggattttggagtatttcagattttggatttgggatactcaacctgtatttcaactgggaatagtttgtttctcaaattgtagttcccttatgatttgaggacatactctaaggatccttaagtttccttgtgaaaaaatttttaaaaattgtgttattggctgggcgcagtggctcatgcctataatcccagcactttgggaggccaaggtgggtggatcacctgaggtcaggagttcaagaccagcctgaccaacataatgaaattctgtctctactaaaaatgcaaaaattagccgagtgtggtggcacaaacctgtagtcccagctactggggtggctgaggcaggagaatcacttgaactctggaggcggaggttgcagtaagccaagagcgagactctgtctacttttttttgtttttaaaagaggaagtgaggaaagtaggtgaacaggaggaatgatgaatgatgctgttagacagaatctccagaccattccttggtctttgagttcctcctgggacctattttgttgttgttgtcgtcgagacagagtcttgctctgttgcccaggctggagtgcaatggtgtgatctctgctcaccacaacctccacctcctgggttcaagcgattctcctgcctcagcttcccaagtagctgggattacaggcatgcaccaccacgcctggctaactttttgtatttttagtagagacagcgtttcaccatgttggccaggctggtctcaaactcctgacctcgtgatccacccgcctcggcctcccaaagtgctgggatgacggacgtaagccaccatgcctggacttttttttttttttttaagctccacttagagccatctcaaacatacgattttcaaaactggactcgattttttttttcctcttctccccgccctctgcaaatctatacttgctgccatcatccttattttaattaatggccgtcctgtctttccagttgtcagggtaaaatctgaatgttatcctttatgacttcgattctcttaaccttaggtgtaatctgttaggaaatcttactgactctagcttcagaatatttccagaatgtggccactccataccatctctacctctaccacccaagcccctgtcattttatagcatattatggctgtaccattagcctccttgctggtctccttgctgttttatctttgcctccttataattattttccacacagcagtcagtgatctttcaaacaaaaaactttactgatgtttataagcacacacaaaaatgcacatgttatgagtttgcagtgaattttcgcaaactggtcatacctgtgtgtgaccagcgcccagagcaagaaacggaatgtgaccagcaactcatgctgccttccagtccctgtcccaagggtaatcatcaccttgacttgtagaacataggtcagttttgttgtttttgtactttatctataataaatggaatcgtacaatatgtactgtattgagtctggcttcttttatgcagccttatgtgtgtgtgaatcatccatgatgttttatgaaattgtaaatggtttcttctcattgctgtgtgctatcacattgtgttaatataccacgatttatttatccattcttccattctgctaatgggcattcagatagttcccggctttaggctattttgaatcatgctgcttggacattctagtacgagtcttttggcaaatatatgtatgtgtttatgttgggtatatacctaggagtaggatctgtggttcatgaggtatgtgtgggttcgggctttgtattaccaaataattttccaaaatggttgtaccccagcgagtgatcttttaaaatatttgttaaatcctattatttgttgtttgaaagcttgtcagtggtttatcaactcactcaataatagctgaaattcttacagtggcatatcacttgtcttcctacttctctttgaacatgctaagcacacgtatcttcaggcctttgtgctagctgcccccactacctcatttgttataccacctagctatgttacctgcttaaattcagatgtctgctcacaggtcactaacatatgtaaaatagcctattcttttcatctctgtccctttattttgcattatttttcctcgtactacttactactgagcatgtctatgtttaatatgtgtaacatttgtctccccgccacccaccagggactttgtttttttgttaattgttgtatccattatcctctagaacagtagacattaatagttgcccaataaatagttgagtgagtaaatgaatacataaaacaaatagttgtaatagacataatggatgaaaatagaatttggggagaataagacaaatgaggttaaaaattgataaaaattacttaattttaatttttattaaaacatagctgaaaaagacacagggcttaaaatagcaactccttatctcattctaattcctactctccaaagttaactactttgttctcttccatctctttcttttctttttatttttttttttgagacatattcttgctggatcacccagcctggagtgcggcggggtgatctcggctcactgcaatctctgcctcctgggttcaagccattctcctgcctcaacctcccaagtagctgggattacaggcacgtgccaccaagcccagctaagttttgtattttttagtagagacaagtgtttcgccatgttggcaggctggtctcagacgccatgttggccaggctggtctcagaactcctgacctcaagtgatctgcccacctcggcctcccagagtgctgggattacaggtgtgagccactgcgtccagcctcatctctttctcataccattaaacttgatatttctaaacttttagttaaattgctatctattttatttcagttttagtgggtttttttttttttcatagctcactgcagcctcaacttcctggcttaggtgatcctcccaccttagcctcctgagtagctggactacaggcgcataccactacacctggctaatttttgtatcttttgtagagacagggtctcgccatgttatccaagctggtctcgaactcctgggctcaagtgatctgcccgccttgggctccagagtggtgggattataggtgtgaggtgccatgcccaacccagttttagatcttctttgttggctcttacgctgaaagataaggactttccttttctgtatttcccctctccccacaccacacattcatacttttcttcctctatcctgttgttataattatcagatttaagatgtgctttagatgtcacttccttagagaaatgttccctaacttttcatcttaaaccaatgtgttcagtgtttacattattatgactacataaagattgttcatatgatacaatcaacatattgcgatcacatgcttttttttcttccctggaatccttcataaatctctttttctttgcttacttttcttcacatcaccagcttatccacatacactttgctggaattctaaagtaaatacatcaggttatgcatcagttctttagcttgtttcggaagcacatctcctagaactgccaacctgtgctggctctgtactgctgttgccctgaatcttaccttcacaaattaagaattcccttcatcaccaggtgtggtggctcgcacctgtaatcccagcactttgggaggctgaaacaggtgatcgcttgagtccaggacttcagaccattctgggcaacatggcataaccctatctctacaaaaaaaaatttaaaaattagccaggtgtgatggcgtgtgcctgtggttccagctacttgagaggctgagatgggaggatcacctgagtccgggaggttgaggctgcagtgagctgtgatcatgccagtgtacttcagcttgggtgacagagcgagaccagtctcaaaaaaaaaccccaaaacaaataattcccttcctcttttttcctatattaaattttttacctctggatccccacatcaggatctttgttggtttactcacttatcttgggagaacatatcctccagtagttcctagagaaaagtgatcctcccacctcagcctcccgagtagctgggacccacaggtgcatgccaccacacccggctaactttggtattttttttttttaagtcaaggttcgccatgttgcccaggctggttttgaactcctgagctcaagcgatttgcctgccttggcctcccaacgtgctgggattatagggatacaccaccacgcctgaccagggatggtaattttttttttgatcttgtgtatcagttatctattgccataatactatatctcagatcactgagagacctcagttgcacataatagtaagtgtttattggccatatgtctaggatagttggctgggaggctctgctgatctcgagggttggccagctattagctgatctaggatggccttggttggaatgactagggtgactgcctcttcttcatttgtttcatctttcttggaggaccagtggtctagccaaggtgtgcttttctcatggtaacagtggagggcaaatggaatgcataagtgcttttcttacatttgaagtatatccactacatattcagaaatatcctattttggaactatagtcatttggtgaccagaaaaattatccatgcaaatgtgcagagaaaaaatttaagatatttagtatccttcagacgactaaacagtcgtcactttctcaaggaggtgttctttgcctttttatattaggtaagattctcctttaaatctcactattagcacttggttattgttatttcataattatcacactggctatattatttgattcatattggtctgtctctctagaccttaagctccactgaagacagcaacccagtccagcatagggttagcctggggcctgcagtagtgagtacataataaatatttgtcagacaaatgaatgaaatgattagatctcaggaatagaaggtatttttagggttctttttattggctctttttgtatttgaagtgtgttccttcttcaaggatttggcagagaagaggaaaaacatagaccattactaatttgcaggagagagaagctggcccagctttgggctgtttgctcggcctagctgcattcccctgtgtaatcaagactgtaaagctttgatgggtagttagttctttgtggctttagggctttccgatataagtaattgttttcatgagtgtattaatttgactctggaacttgtaagcaactggaaacaagactgttcctacttgtttatgtgaatgtttgttgttctgaattggatgacgatactcattgttatttcagaggagtggttgaagaatacatttttaaactaattagtgatggagttgcaatacagttttgtcattggtgctgcattcaataaacttatattacagtctaaatcttggaatgtatggaaaattaacattaattaaactaatctaagttacagaaagctgacaagtgaacagaactgaatattaaaaactattccttaaacatgagtttacttcatccactctatggtgtttagttctacttaataattccagccttttcataatttgaaaggagacccatattttgtggcttattgtttgttcaactttgatattgattttaattgttaggacaggaaattgtgatagaactagaaatttcctcccaggattgaaaaaagaccttgctcaggtgtgatctaaatattatatttcttattaatgacaagtttttttgtgttttgcttttttgataattaaggagtaaaatatatgctatatattatataactatggaattttaggtcttaaatggacaatatcaaagcagcctagctgtctttaaaatatttatatttttatatatattttatatatatatttatatatataaattttttaggtcgggcgtggtggctcacacctgtaatcccagcactttgggaggccaagtcgggcagatcacaaggtcaggagattgagatcatcctggccaacatggtgaaaccctgtctctactaaaaatacaaaaattactgcagccttgacctcccaggctcaagtgatcctctcacctcagcctcccaagtagctgggatcgtaggtgcacaccacgatgctcggctagttttttaaatttttgtgtagagacagggtctttctatgttgcccaggctggtcttgaactcttgggctcaagtgctcctccttccttgtcttcccaaagtgctgggattacaggcatgagccacctggcctagtttgtttcattttacatagcacttaaattgtaaatttttttttttttgacagagtcttgctctgttgcccaggctggaatacagtggcgggatcttggcttattgcaacctccacctcccaggtttgagcgatcctcctgcctcagcctcctgagtagctgggattaaagtgcccgccaccacgcctggctaattcttgtatttttagtagagatggggtttgatcgggctggtctcgaactcctgacttcaggtgatccacccgccttggcctcccaaagtgctgggattacaggtgtgagccactgtgcctggccagattgtaaattttatgagcctactgttggttggcagtagttgttcagtaaatattttttgaaagagttaataaatgaatgcatgtagttatggatgaagattacgtgaataaagactgaagcccagagaggttaaaaacttatgtgataatccaagacaataaataaagctatttgggaatgttctttattgtcccctgatggatgtgtggaattgttttactagggaggaggattcagcagaagctggataaacaattatagggtttttatgtggtgttgacatgtagaatagccaaggttaaattggccaattaaagctggagtaagatggctttaggaagtgttatatattaacagaatgagagaaataatcagaaataatttcttagtcccagtagccattaagtaggggaattttaatttttaagtgatggctccaggtcttcatgtgtataagattcttgcaggaaaattttttgatgttactagtaattttaaaggaatatgtgtaaaaggcttagggtagtgctcgctctacaactagatatttgacaatctaagcctagattataactgaaatataattgtgtaatcttgtccttacttctatcttatttttttgagacggtctcactctgtcacccaggctggagtgcagtggtgtgatctcggctcactgcaacctctgcctcccgggttcaagtgattctcccaagtagctgggactacaggcgcctgtcactacgcctggctaatttttgtatttttagtagaggtggtgtttcaccatgttggccaggctggtctctaactcctgacctcaaatgatccacccacctcagcctcccaaagggctgggattataggcttgaccactgtgcccgggctttactcttattttaaatgtcagtttgttaaggacagaaaaaaagactgaattttgctaatattttctacacttgatcttagccaaaaggccgagaagcgatgaattttgctaatattttctaacatgaaaaggaaataacgaagggaaagtcttttttttctttttaactttctgcagcagttgggcaaaattcctgctttgtgtaggaaaccctggcagaccttgagaattctaaattgctgcagattgttttatcttttttttctaaaacaatttgaatagcggatcctttccatctgaaacaagtttttccccttctcaccctcttgtttcatgtaattagcagtcctcctctgtatattcctattttgtctgatatagccaaaattctttaaaaagaattttaaaattttaaaattctgctgtgagtccggcaaaggggctgagagaatttctgtgtcaacatcattgagaactctgaaagcttctttacataccaagctcctcctcatcaaagctagatacaggaagtgtttatggtccctttcttccaagggaatggctctaaactaaccagcagaccctgtctcacttatgttctccttcaggttcttccttgacatcctactggctactcttagtcatgttctttctagccatcaagtctccaaactgcgtggccagacaacttgagttacctgggaagttcctaggggctagataagtactttatgccttattctacagcagaatatttgttttgtttacatgaccagctcagattgatagaatagctgtcttttagcaacagtgtaatcatttaatgacagctgttcaagggactagtaaaaggattgggaaaggggggccttctaaacaaagtgaatgggccctgccaactgaggagtgatgtctcctaaatggttggcatgttcagacttcagagtattatccatcagcttggagacccacaagttttttaaatatctagtgttatctgtttacctgttagcttggtgccaaagtgattgcaccttacctccagaccatgtctgtgcttgccctgatgtacctgtcatgttcagtacctgttttggtttatagggcttggactagctccgatgttcacttgccctgttttacttagagaaagtcatcatgtgactaaattttaagattacaaagataatgcatgtgatttagacttgagtgtgtaaaaggcttagggtagtgctcactctacaactagatatttgacaatctaagcctagattataactgaaatataattgtgtgatcttgtccttacttctatcttatttttttgaggcggtctcactctgtcacccaggctggagtgcagtggtgtgatctcggctcactgcaacctctgcctcccgggttcaagtgattctcccgagtatgggtggtgatggaccatttgtaaagcctcagaagccaaactggaattaatgtgaaagttatagggaagttagtttcagcttaatcaaagtagaatttccaaaaagtagagccatttgaaaatgtcctgtggctgggcgcggtggctcacgcctgtaataccagtactttgggaggccgaggtgggcggatcacgaggtcaagagattgagaccatcctggctaacacgatgaaaccatgtctctacttaaaaaaaaaagtcagctgggcatggtggcaggtacctgtagtcccagctacttgggaggctgaggcaggagaatgctgtgaacctgggaggcggagcttgcagtgacccgagattgcgccactgcactccagccggggtgacagtgcaagactcagtctcaaaaaaaaaaaaaaaaagtttttatcctccagatcgtagaattatattactagaggtggtgattcagcagaagctggataagcaataatagggattttgtgtaagtgttgacatatgggtagggtgggctaggtgatttgctaatagtgagatattttgattcaagtataaatttcagtagttgcagatgaacacagaaggaacaagcacagatttctgctgatggttagtaagacaacattgccaagggagggtgtccccagaagagcagaaaacctaatatgaaagctcaaatttaaaagatggaagcaggaagtaaactgctgaaggagaatgttcagaggaagaaaaccagagggtttagggtacaaaggctgagggtggagagtttgaaggaagaagaagaaattagagaaccataaagaaaatgatatattctaaagcggtagtcctcaaggtaaattgcatgtagctgtgccttgggatgcagtaggacttacatatatatatatgaatgaatatgcatatacattaagcttattattattattattattttgagacggagtctcgctctgtcacccagactggagtgcagtggcgtgatctcggctcactgcaagctccgcctcccaggttcacgccattctcctgccccagcctcctgagtagctgggaccacaggtgcccaccaccacgcctggctaatttttttgtatttttagtagaggtggggtttcaccatgttggcgaggatggtctcgaactgctgacctcgtgatctgcccgcctcggcctcccaaagtgctgggattacaggcttgagccactgcgcccggccaagcttatttttatatggatttcatgatgtatatattttgtaatatatataatttataagtaaatataaattagggaggtgtactcaacattttcatagaatacatagtcaaaaatggtttgcaacctctgctctaacaaaaataaaacaccctacatctttggttcaagattgtcacccccaacagttgtgtgaaatgtggggcaggaattatcactattttcctttggaaattaaggttccaaagataatgagaccagagccaaaggtcagagtccactgtcttctctctgaggcctcaatgtgaagacctgaactgtggcagcagataattctggagacctgttaatcagctgtatgcaccacgctacttaattgatttagaaatattgaaaaggccgggcatggtggctcatgcctgtaatcccagcactttgggaggccgaggcgggtggatcacctgaggtcaggagtttgagaccagcctcggtaacctggtgaaaccccgtctctattaaaaatacaaaaaaacttagccgggagtggtggtgggcgcctgtaatcccagctacttgggaggctgaggcaggagaatcacttgaacctgggaggcggaggttgcagtgagccgggattgcacctagtgcattccagcctgggcaacagagcgaggctgtttcaaaaaaataataatagaaatattgaaaaggcgtgggacaaagatagggtctcaagacccttactgtagtcaggggtgttaatacgttttagactgaaacctgtgaatgctcacaggtgcaaatgaaagtgacacagatactacaaaagtgctttcgtttgaccacaaagaaattctataggtctgggattctcaaagttttgacatgtcattttaagaatcttatacaaagtatagaccttttccccagaagtatgcatacacacacatactttggcatacagtttgagtgaatgtctcgttctgcagctgccctagagcatccagggacctcagctcatcatttgctaactttaccaaatgatgggttaaaattctcttccttggtaaaattctgcccacaccctatcttttgggcacttaattatacctaaaaatagcattgagaaaagcagctatttcatccacaattagagaatattcttgagtccagcatcaaagccattatggtgctttgatcaataagtttgttctccacggaagtgaggcttaatggcttaggtgaccgactaactttctccttagttgctctagaagtcacctgtgaatgagccctttcaaagggaatgattttgacttctgaaaacttaagcagattagaagccttgagtataggatttagaataagaagtactcagtagtaaccctggttgtctaactacacaggcttgtatgatttgaacttttgttgttgttgctcttctggtttccttaaacaccagacagatccgattacaattctaaatatttagttctgtgcaaacaggaacagctcaacagttcaccttcactgagtaacgtatgtctatttagataagcaaactactgttgcaaaaaccctggcaaaatgtcaggatgagcaggggaaactttcattatcttttcagccatccgaacagttccccaagaatcggacatttttgagacttaactagtcaaggttaaattactcattgttcagtgagtaaattctgtctaaagacttagctggggtcgtctttattttatttttttcattcttctttttttttggaggttacttcaacaaataaagttttatttttatttaggctttccttgtattttagggaagagaaaatatttgctttatgttcttaaagtgagtttaaaaaaaaaatggtacatttaaagatagtttggggacgggcatggtgactcatgcctgtaatcccagcactttgggaggctgaggcgggcggatcaccttaggtcaagagttcgagaccagcctggccaacatggcgaaacccgatctctactaaaaatacaaaaattagccaggcatggtggcgcatccttgtggtcccagctacttgggaggctgaggcaggagaattgtttgacccaggagacggaggttgcagtgagctgagatggcaccactgcactccagcctgggcgacagagtgagaatcctatctcaaaataaaatacaatttggggtttcttaatgcctatactcctttgtttaactatagggcttctagttctttaaagatgattagtgattgtacaaaaggtataatataataattataacagcctcttacttttcatatccattaaacttttttttttttttgagacagagtctggctctgtcacccaggctgcagtgcagtggtgcaatctcgtctcactgcaacctctccctccccggttcaagcgattctcatgcctcagcctcccaagtagctgggattataggcatgtgccaccacacctggctaattctttgttgttttttgtttgtttgtttgtttttagtagagatagggtttcattatgttggccaggctgatctcgaactcctcacctcaggtgatccgcctgccttggcttcccaaagtgctgggattacaggtgtgagccaccgcgcccggtttaagccaccgtgcccggtcttaaactttcaagtagacaggacacactggctacttgtgtgcccccagatgtatagaattatgttactagggatggggatgctacagaagctggataagcaattgtagggattttgcgtgggaataaaagtgtggaatggctaaggttaaactggccagtttaagaaaactgaagagcaagatggctttagtaagtggtatagatgaatagaatcagaaaaataatagaaacagtttctattagtgtagttcccaataggcattaagtaggagaattctaactttaagctatagcaatggctctaagtcttcatgtgtacaaagttcttggaagtaaaagtgaaaggggtgggcgtagaatgagcctcattcctaaccagaacactcatcactgaccacctatacttgttttgtaacagagtgaagcgatctttaatgcaattttgatattctttccatccactcttgcattttgttctttgaggtgtgagagaagtgtgtatctgtccgttccttaatgtacagtgccttgaatggttgacggtgtggaactttaaagatctttgtgtaaatttaccttctgatttcttttaccccctgttcctcagcctacatggagaactttcactgtaattggagagtaggaatagttatctctgtgtacaaatgagacccaattcttacattttccattgtggctgtaggaaattttattttattttgagacattcttgctctgttgcccaggctggagtgcggtggtgcgatctcggcacactgcaacctctgcttcccaggttcaagcaattctcctgcctcagcctcccgagtagctgggattacaggcgtgtgccaccatgccaggctaatattttatatttttagtagagacgaggtttcaccatgttggccagactggtctcgaactcctgacctcaagtgatctgcctgcctcggcctcccaaagtgctgggattacggatgtgactcgccgcaccaggccagaaattttaaattttgaaatggtgtgccccttctcttacttggttctcttcataaaatccctccaacttcaaaagggatggaaataattaatggaagcaaataagatattgattaaaaggatatttatttttagtaatatttcttttgggttacttccttgccccattttaagattacagtatctgatcttaggatttgaactgttccatctgctttcctccattacagtgctctcctgctttttcatatttggcttgcttaactatcagaattttgattctttcatttcttaaattccatcgtctgaagtaaagctatactaatttggagtatctgaaggagtagagggaaggccactctgaactagcataagatcttaaatacagagcatttttcaaggaatgttatattatcatttgtactgataaattaaagactagaaccacaatatattacctagtattggtccttaaggaatttgcaattacctgagccttggttttgcatgtaaatagatgcttctaagtgcttgagtctactttgaaagagttcttaatagtttaaccagtaacacttagtcttggttatactcttatttagtaaacattttattttttttctccatagatggggtaaaggtaaatttagctcagctgtatgaactattacattaaagttttttagagcaatttttatagcttttctctatatacatttgcatttacattacctgtatgtactatacatacaaattgatatgtacatgctgatgtattaaaatccctgagcaaactacatatttgtggacaatttgagcaaataatcttttgagtataaacttagactaagctttctgagtacaggaatcacatactttgacattcttctacttgcttccaaagtaaacatatttgccaaaaactttgcccaggtacccacattgtagtgggggcagccttttactgggagcaagctccaagttccttttttttttttttttttgagatgcagtttgctctcttgcccaggctggagtgcagtggtgtgatcttggctcactgcaacctctgcctcctgggttcaagtgattctcctgcctcagttttctgagcagctgggatttacaggcatctgccaccaagccctgctaatttttgtatttttagtagagatgggtttcaccatgttggccaggctggtctcgaactcctgatctcgaagtgatcctcccacctcggcctcccaaagtgctgggattacagatgtgagccaccgtgcccggcctccagttcttttctgtttggtttgtgagtgagtgagaatggagtgtgtgtaaagggggactgggaggctgggaggttgacctttgtgcagtctacctacttgtgaatgggaatgtgattccatgcctattgctgattctcaagcctgcctcggtaccacagtagttcacagcaagggctttggagtcagccctgtatttgaacctcagctctctgattttccagctggggatctatgttgggcaaatcaagttaatctgcttaaacttcagtttcctcacctagaaaatgaaggtcataattgcagcctcactagggtatctgtgatctaggagggatttttgatagtggtaaacagtagattcctgccttactaatgtgtaggtcagtttatcatctacctagcaccatcacttttttcaaaaaaggtcttttcaaccaagaatatgtcatacatatctgtattttctgactagattgcaggttcttggtccttgtcttacttgttttcgtaactggcttatagaacttgatactcagcacatgttaattgaatgactagatgatgcatggtctcctttgagcctaccatagcatttggatttaccatcattatgtttacttatgtgcgttgagaaacttatgtgatataaggtttgctttaaactatgaggtcttaaatatttcccatggtcagagtagattattgatctagtttggctagacatgttccctaacttccttaggattgctgttagacttcctgaagctgaatttttgtgggaagaagattaagacttttgtgacttaggagaggtaagttttccctagttgtatactagcaggggctaacttacctgatttcaccctttaattggtcaaaagttttggattgcagcaacttctgtataactttttccaaagagaattctattatctgataattttggaatgttttttgttttgtctgttgccttttgcttatagtggattgtttcctcctattgtttgtgattgtggcttgtgagtaggttttttgttgtttctctctcccaagaagagctttacctgtggaatcctgtatggctttggttgaggatgtattctttgttgttaatttcttgacttaaaggtttcaggacgaccaaggtagtaaaaatttaagcttcaaacctacgtaaggtgtaggtctgtcattaaaaattttcagggtatacttttccttccttccttcccagagcctcagcagaggcaggtaagtgtccttagcagctcacctggcttggtgggcagattctttgtggtctactcttttcctaaaggggcatccctttggaggttctggctttatgtcaaaatcttttttctgtgtgtgtgtgagtgtgacagagtcttactctgtcacccaggctggagtacagtggtatcatcttggttcactgcaacctctgcctcccgggttcaagtgattttcctgcctcagcctcgtgagtagctgggattacaggcacatgccaccacgccgagctaatttttgtatttttagtagagacggggtttcaccatgttggccaggctggtcttgaacccctgacctcaagtgatccacccgccttgggctcccaaagtgctgggattacaggcgtgagctaccgcacccggctcaaaatcttaacttctactccttacttgatatgagttgtgaagttgcagacatataatttattctagttagtttaagcaggagaggtttaccataaagcattaaacaccaacaaaattgccggaagggctgaagaaatagatttcaagtttgttcattcaatcagatatttattgagcatctaccatatgtttagtactatttttgggttcttggggaacacattagtgaacaaaacagacaaagctcactttccttgaggaacttacgttctagagggttttgtctttaggaacaattctcaaagccacacacaaaactggccaacaaaatagctgccagttggggttttaaaaaccaacccagaaccacatgaccactgccatggttaggaaaccacactgatcaggaagcctccactaaagctgtcggctccagaatcatgctcatctgcttttgatccacagtaaatacccaggccttgcctctgatacccgtgacactagttactagacactgtacactcaactaatgatgctgcagaacaatcaaatgccttggcctatgcctgtttgcaaagtagcagaactaggtcttcagtttctctttccaaatccatgttagtgcatatgattggtggaacctaattacatcaggagccctagctggaagaggctcttgagccttcatggtacagagcagacgacctacaaagaaaggagaatattcaatgccaatcgaccaaatgttcctttcttcttcatgttggtttttaaaaccctatcccctatattatgggtgtagatctctattttgccatcccagctcaggaaaggggctgcccacatgcgtttggtttttagttctctctgcttttctggctcctggggttttcttcttcttattcttcctcctccccctcttcctcctcctccccctcttcctcctcctccccctcttcctcctccttcctcttcctcctccttttttctctccagacagagtctagctctgtcacctgggctggagtgcagtggcatgatcatggcttaccacaacctctgcctcccaggttcaagtgattctcctgcctcagcctcccaagcagctgggactacaggcatgtgccactatgcccagctaatttttgtatttttagtggtgatagggttttgccatgttggccaggccggttttgaactcctgacctcaagtgatccacctgccttggcctcccaacgtgctgggattacaggtgtgagccacacctgtcctttctctttcttgctaactcagctttgcctttaaaataatatttgttctattatatgtagagtttttgggggaaagttttcaggttatgtagataatttcagaattagatgcccctagtttacaagtactaatttaataaaccatgttagcttattaaaaatgtgttacgtctggtgggggtgggggttggagaaagatggtaggcattccattgatttaaagtttttttttttgagatggagtttcactcttgttgcccaggctggagtgcagtggcgtgatctcggctcaccacaacctccgcctcagcctcccgagtagccgggagtacaggcatgcaccactccccccagctaattttgtatttttagtagagatggggtttctccatgttggttaagctggtctcaaactcccgacctcaggtgatctgcctgcctgggcctcccaaagtgctgggatcacaggcatgagccaccgtgcctggcctcatagtttggagtttttaaggaattggtccattttatcaaagttgtccaatttgtgtgtatagaattatcgtattatcctactatccttttattatctgtgaggtctgtaatggtattcccctcttttttattcctgatgttgtaatttatattatgtctttcttttttgttagtctttctagaggtttatcaattttattgatcttttcaaagaatgaaggtttggtttcatttttttttttctattgtttttctgctttcagtagttacaacagcagtgcctctacctttttatttggccatccctcttgtatccctatattctgccatcttttttttccactttttattatcaaggccttttcttcatcaaggctgatgaaatttcatactgtttataactgcaattaagacttctttgggccaggtgcaacagctcacgcctgtaatcccagcaccttgggaggctgaggccaaaagattgcttaaggccaggagttcaagaccagcctgggcaacatagggagaccttgtctctacaaataatttaaaaatcagttgggcatggtggcgcatgcctgtagtcctagtactcgggaggccgaggtgggaggttgaagctcagtaagctgtgattgccctactatattccagcctgggaaacagagcaagaccctgattcaaaaacaaaacaaaaaactttgatttgtgaataggttgaatctaaaagttaatttatttgcattatcataattacataaaaattgttcacttcatatcctagtagtatacctttctttccttgtacagcatttattttctcatggcctttcttccacgagatatttgcctttgttatgtcctcaattattttcaagctctccattgtataattcattctcttattctattcactcacatctccaacctcctcctagagcacattgtttctccaaactgggctgactgctctctagagctgacatcctgtgacttcccattactgctttcctagattatttcctggatcccatatcctctcctttctagacatactccctgattttgatgaaacatgtcagtaaggactgtcctaaagaaggtgaagagaaaggatactttctgagtcctttcatttagctctacatttgatgagagttgggatgagaatggaattctagattgaagagaattttccctgagaattcttatggattgcttcattgtctgcaagcatccagtcttaataatgaggaggccagttttatcctaattcttgatccactgcaggtgactgatttctctggaagcttttcagaatcttagtattttgaaagattggaaataggtcttttacaacttgctgttcgggccattgataggccattttagtttgaagatgcatgttctttccaaatattattttgatagttttctcctgttttctgttttctctttctggatattgaatatgtataaaagtttgcttcgaattctgaagaataaatataatgggaagacagatgtgaggtctagattcttggttttaatatttatgtagcatttgtctaaaatgtggaagtcacatgctgtagaccaactaagtttgtaaaatatttgtaaaatatttataaagtataatttatataaaaagcagttaagaaaaagacccaaataatataaagttaccattataaggtcccatatgaagctgtccttcaattaagaacaaaaatcaatgtacaggataaagctacaatattaagcaagaaagatacattttaattttgtttgcagtcccattagatttctaatatgattttatagctcatttcctccccttttacaaatggctttgtatcataatctgtagcaactctaaacattgcaagagtaaaagaatatactgacattacttcatggtttagaacaaacaccttgagaataaaaagtcatgtttaacatgacttgcactgaactagatacacaccatatttatggctttatgtcagtgttcaagtgtttttgttttttttttctgtttcttgatggctctgattaagttagagttaacaaactctcttctgatgccacattagtgggcatttattttctggcttgtaaaagcaggattagtcccttagactgaagccacacttgtgtttttcttactcataatgcaaataatgacttcaggcagtggtgtgggtgttcagcgaatgcatacttctatttgcagagcagttttacctgtatctacagcagggaagcccctctgggctttatttagtaggtgacagaggaaattagaatggcctggctaagcacatcaatatgcataattgacaggctattcaatactgttaaagataagtactttccattctttaactatcaaatgcagctcaaatgtattctagattgtattattttctgagtattttgttacagatccttcacgtatatatgcgaacttaaagtaaacaaatctaaggaactagaaaaacacaggcttgtctctgggcaaggtctttaaaattatcaatgtgattataatgaatgaataacatatagcccttcgaagggataaggtaaacaccaagattggaaaggcagacataaaactttattcacaggtgacacgatcttctatatagaaaatgctgaggaatcgactacaaaactattaggtttaggccggcagggtgactcacgcctgtaatcccagctctttgggaggcaaagccagttggattgcttgagaaccaggagtttgagaccactctggccaacatggtgaaaccctgtctctactaaaagacaaacaaaaaaacctattagcattaataaatgagttcagcagggttgcagggtacaagagcaatattaaaaaatcacttatttctttttgtttgttttttgagacagggtcttattctgttgcccaggctagagtgcagtggcgcaatccgggctcactacagcctctgcttcctgggttcaagtgattcttgtgcctcagcctcccgagtagctgggattacaggcaaaaaaatcgcttatatttcttttttcttttttttttttgagacggagtcttgctctgtctcccaggcttgagtgtagtggcgcgatcttggctcactgcaagctccgcctcctgggttcacgccattctcccgcctcagcctcccgagtagctgggactacaggtgcccgtcaccctgcccggctaattttttttttttttttttgtatttttagtagagatggggtttcaccaggttagccaggatggtctcgatctcctgaccttgtgatctgcccgcctcagcctcccaaagtgctgtgattacaggcgtgagccactgcacccggccaaaaattgcttatatttctatacacttggatctgataatgaaattaagaaaagagttttatttacaataaaatacttaggaataatttaattaaaaatttcaaaacttgtgttctacaaactaaaacattaaaagaaattaaagactcaaatggaaagctgtgtttgtcgactcatggattcatgaattagaggactatttttaaaatggcaatgcttatcagatctacctatttaatacaatccttatcaaaatccaggctgcccttccccccccacctctccgcaccagaggttggcatattgatcccaaaattcatgtggaaattcaagggacacagaatagctaaaaacagtcttgaaaaaactttcaaaatttactgttggccaataagcacatgtaaagattcttatcactaatcactagggaaatgcaaattaaaactttaataagatgttacctcagacccattctgatgactactgtcaaaaaaacagaacataagaagtgttggcaaagatgtggggaaattggaacccttgtgcactgttagtggtagtttaaaatggaatagctgggcatggtggctcatgcctgtaatcccagcagtttgggaggtcaaggcagatggatcacctgaggtcaggagttccagaccagcctggccaatgttgtgaaactccatctctactaaaaatacaaaaattagttgggtgtggtggcaggcacctataataccagctacttgggaggctgaggcaggagactcgcttgaacctggggagtggaggttgcagtgagccgatatcatgccgttgcactccagcgtgtgtgacaagagcgaaactccgtctcaaaaacaaataaataaataaataaataaataaataaataaataaataaaatggaatagctgctatagaaaactgtgtggcatctcctcaaaaagttaaaaatagaattaccgtatgatccagcaattccaattctgagtatatgccaaaaatagagcagtgtcttgaagagatatttgtacacccctttgatttttttgtgtgtgttttattttattttattttttattttttttgagacacgatctcaccgtgtcactcaggatggagtgcagtggtgcaatctcggctcactacagcctcggcctcctgggttcaagcaattcttgtgcctttccctcccaagtagctgggattacaggtgcgtgccaccacacctggctcatttttagtagagtaagggtttcaccatattggccaggctgttctcgaactcctgacctcaaatgatccactgacttggcctcccaaagtgctgggattacaggtatgtactaccatgcccagctaatttttgtattttagtagagatggggttttgccatgttggccagtctggtcttgaactcctgacctcaagtgatctgccctccttggcttcccagagtgctgggattgcaggcatgagccactgtacctggcctgtacaccatgtttataatagtattattcacagttgctaaaacatagaagccaaccaactgtccatcagtggatgaatgggtaagcaaaatgtggtatttaccaacaatggaatatgttctgttttaggaaggaagaaattctgacatatgctacaacatggatggaccttgaagatagtatactaagtgaaataagccggtcacaaaaagacaattactatatgattctacttatatgaagaacttagattagtcaaaattatagagatagaaagtattagggtggttgtcaggggctgtggagaggggaatatgggaaattgttgaatgcattttagttttgcaggattaaaagaggtgtggagatgggtgttggtgatggttgtacaacagtgtgaatgtactcagtgccactgaactgtacagttaaaaaaatggttaaaatggtaaatcttatgtatgttttactgcaatacaaaaaattgggggaaaaaatcttattacacagctacagtaatgaagactctgtgttagtggccaaaggataagcatagatcaatggaatagaattgagactagaaataaaccctaatatttatggtcaattgatgtctgccccatcccagccccacaaggatgccagatgagtcaatggaggaaagaaaagagcttatctatttgtagactattcattctcatagtcttttcaacaaaacagtgtgctgagacaattggatatccacatgcaaaagaatggaaatagaccccttccttatatcctacacaaaaatgaactaaaaatatatcagagacctaaatgtacgaactaaagctataaaacaggccaggtgcgctggctcatacctgtaattccagcactttgggaggctgaggtgggtggatcatttgaggtcaggagttcgagaccagcctagccaaaatggtgaaaccccctgtatactaaaaatacaaaaatagccaggtgcatgcctgtaatcccagctacttgggaggctgagacacaggagaatcacttgaatcgggaggcagaggttgcagtgagccgaggtcctgccactgcgccccagcctgggtgatcagagcaagactttctcccaaataaataaataaataataaaactataaaacacctagaagaaaacaggaataaaccttcatgactttggattaggtaaagctttcttagatatgacaccaaaagcaaaagcaaccacagaagaaaattgatgaattggacatcacagttaaaaatttctgctcctaaaggataccatcaaggaagtgaaaagaacccacagaatatgagaatatttttgcagattatatctgataagggactgtaagagttctttattctggatacaacttaatagtaaaaagacaatccaatttaaaaatgggcaaaggatcttaatagacatttctctaacaaggatgtacaaatgaacaataagcacgtgaaaagatgggaaatacaaatcaaaactacaagacagcactttgtactcactaggacggctataatagaaaaagataacaagcctgggctggcgaggatgtggctgacaagactggaatctttttttttttttttttgagacagagtttcgcttttgtcgcccaggctggagtgcaatggcgtgatcttggcccactgcagcctccacctcctgggttcgagtgattctcctgcctcagtctcctgagtagctgggattacaggcatgcgccaccacacccggctaattttgtatttttagtagagagggggtttctccatgttggtcagacttgtttcgaactcccagcctcaggtgatccacttgcctcagcctcccaaagtgcagggattacaggcgtgagccactgcgcctggctggttggaatccttatacattggtggaggtaatgtggaatggtctaactgctctgaaatagtttggcagttactccaaatgctaaacatagatttaccatatgaccctgcaattctgctactaggtatatgctcaagagaaagaaaaacatatattcacataaaaacttgtacgcagttgttcatagcggcattatttataatacttaaaaagtggaaacaacccaaatgttcatcatttggtaaatgggtaaataaatgtggtgtatccatgctatggactattattcagccataaaaaggaatgaagtatgcatacatgctataacatgtgtgaatctttttttttttttttaataggagtctcactctgttgcccaggctggagtgcagtggcatggtctcagctcactgcaacctccgcctcctgggtccaagcgattctcatggcctcagcctcctgagtagctgggattacacgcacgagccaccatacctggataatttttgtggttttagtagagacagggtttcaccatgttggccaagctggtcgccaacctctgacctcaggtaatccgcctgcctcagcttcccaaagtactgggattacaggcataagctaccacacctagccctccttctagtacttttttaagtgaacttttaaattataacgtgtatacagaaaagtatgcaaaaagttactagtatatagcttgatgggttttcccatccatgtagaattatgcatgtcatgaaataaactgggtgcgttggctcatgcctgtaatcctagcactttgggaggctgagccaagcagatcacttgaggtcagaagtttgagaccagcctggctaacatggtgaaaccctgtctctactaaaaatacaaaaattagccggaaatcacttaaacccaggatgctgtggttgcattgagccaagatcgcgccactgcactccagcctgggcaccagagcgagactctatcttttttttaaaacactattctctcctagttactgtatccccccgggtaaccactgtcctgacattaacatcaatttttcctgtttttatactttatataaatgaaaacatacaaggtgtattcttctgatatgatttcttttacacagcattatatttgtgagttgtattgtagactgtgcattctcattgctgagtagtactccattgcatgaattttttttttttttttttttttttttgagatggagtcttgctctgtctccaggctggagtgcagtggcgcaatctcggctcactgcaacctctgcccccacccccgccccgggttcaagcgattctcctacctcagcctcccaagtagctggaattacaggcacctgccaccaagcctggctaatttttttgtatttagtagcaatggggtttcaccatgttggccaggttggtctcgaactcccgacctcaggtgatctgcccgcctcagcctccctaagtgctggattacaggcgtgagccaccatgctcagcctcattgcgtgattataccacactttattctttctatttttgaacatttaggtagttttcttgtttttagctattatgaatagtgttgctatgaatattctcgaacatgtcttttggtggacatctgtgtgcatttctgataagtgtgtgccaggaagtggaattgctggatcataaggcagtgcttctcaaactgtattgtgcacatcagtttcctgggaatcttgttaaaaggtagattctgcttcagtagttcaagggtagagcctgagagtctgcatttgtcaggagccagttggactggctgtggaccacactttgagtataccaaggccataggatatgcttgtgtttggttttagtaaagaatgccaaatggttttccaaagttactgtctcagtttacatctccaacagcagtgcatgagattcctttgtttaggtgtgtgtgagtctgtttcgctcaaacttttacatatcttcttctagatcgtctcagcttttcttggaccttttgtgttttcacataaattttataattggtatcagtttccacatacaacctgctggatttttgatttggattgtattgaatctgtagatcaacttgagaaagaactagtgtttcaacatccaaattcctgaacatggcttatagccctccattattgaatggtctttaatttctttttttttcccccctccaggttaaagtgattctccttcctcagcctcccgagtagctgggattatgggcatgcgccaccacacccagctaatttttttgtatttttagtagagacggggtttttccctgttggccaggctggtctcgaactcatgacctcaagtgatccacccacctcggctcccaaagtgataggattacagacctgagccactgtgtctggcctaatttctttcagtaatatttctagttttctgtatagagattttatttgctagttcattcttaagtatatgattcgttgatactattgtcaatgatttcattctaaaatttctatttaataattgttggctgctggtatatagaagtacagttggccaggtgcggtgtctcacacctgtaatcccagcactttgggaggccaaggtgggtggatcacctgaggtcaggagtacaagaccagcctggccaacatggtgaaaccccgtctctgctaaaaatacaaaaattagccaagcatggtggtgcacacctgtaatcacagctacataggaggctgaggcaggagaactgcttgaacctgggaggcagagattgcagtgagctgagaccgcaccactgcactccaacctgggcaacaagagcgaaactccgtctctcaaaaaaaaaattgatttttgtatgttaacctttaatggaacaatattggtaaattcacttaccatttttcattgtatatattactttatttttttgagacagggtctcatttgttcacccaggctggagtgcagtggcatgatcatagctcactgcagccttgatctcctagtctccaacagtcctcttgcctcagcctcccaagtagctgggaccacaggcacataccaccatgcccagctaatttttgtatgttttgtagagacagggttttaccatattgcccaggctggtctcaaacccctgggctcaagctcatggttatatatagattctcttggattttctttgtgaatgtaatcgtgtcatatgcaaatcatgacagtttaatatatttcctttccgaggttatttctttctctttctggaatgtactgtttgggacctgcagttgaataggagtgatagtgatatccttgtcttatttcccattgcagggggaaagctttcagtatttcaccattaactgtgatgtttgctttagatttattttcttttttcttttttttttttgagatggagtctggctttgtcatccaggctggagcacagtgtctggatcttggctcactgcaacctctgccttgggggttcaagcaattctcctgcttcagcctcccaagtagctgggattataggcacctgctgccacgcccagctaatttttgtattattggtagagactgggtttcaccatgttggccaggctggtcttgaatccggacctcaagtgatccacccgcctcagcctcccaaagtgctgggattacaggtgtgaaccaccactcctggcctgctttagattttgtatagctccccttcatcagattgaaaaaggccttatattcctaaatttgctaaaagatggttttggttttttggttttaaaatcatggccagatactgaattttgtcaaatgctggttcttcttttacttagggtctcactctgtcacccaggctggagtgcaatggtgcgatctcagcttaccgcagccttgacccctctagctcaagcggtcctcctaccacagcctcctgagtagctgggattacaggtgcacaccatcatacccagataattttatttatttattcatttatagtgatggggtctcgctatgttgcccaggctggtctgaaattcctggcctcaagcgatccttctgcctcagctgctgaagcactggtattaaaggtgtgagcctccacccctggcccatttatatgattttaatttttgaggccttaagttctataacccaataaatttctatcaggggaacccacccccagtatttcaacgtaggttctttctattttccctaagtgtcggctgatctgagaaatagagtacaaatagaggaattttacagctgggcctctggaggtgacatcacatatcggtaggaccgtgatgcccacctgaactgcaaaaccagcaggctttcattaaggacttcaaaagcagggagggcctgtacgaacagggagtaggtcacaaagatcacatgcttcaaagggcaaacaagagaacaaagatcacatgattttgaggaaacaggaccagggcaaaatcaaactcctgataagggtctatgttcagtggtacacatgttgtcttgagaaacatcttaacagaaaacagggctccagagcagagaaccggtctgacctcagatttaccagggtggggtttctttcccaccctaataatcctgagggtactgcaggagaccagggtgtatgtcagtccttatctcaaccacgtaagacagacactcccagagcggccatttatagacctccccccaggaatgcattcctttcccagggtcttaattattaatattccttcctaggaaaataattcgcgatatcttccctacttgcacatccgtttataggctctctgcaagaagaaaaatatggctctattctgcctgaccccgcaggcagtcagaccttatggttgtcttcccttgttccctgaaaatcactgttattctgttctttttcaaggtgcactgatttcatattgttcaaactcacttgttttacaatcagtttgtacagttagatacaattatcacagtggtcctgaggtgacgtacatcctcagcttatgaagataacaggattaagagattaaaataagacaggcgttaagaaattataaaagtattaatttggggaactgatatatgtccgtattaaaatgaaatcttcacaatttctgttcctctgccgcggctccagccggtccctccgttcggggtccctgacttcccacaacaatttctcttcactaaaataatcacatttttgctctatgtctctgaaattgctcctaaatcccactgagtagagtttgtgttctggatctcttcagtcacatatttacaatatcttgtgttagattgctggaggatttttttttttttaaaccagtttccatgtttgattctagagagaaacctttatttatcttagcttcaaattactattgggcagggggctgtacctcactgtcactcaggatcaactgtgtaatttgtaggacccagggcaagatgaaaatgtgaaatactttcctcaaacattaagaatttcaaaacagtggcaaagctttataccaagtgcaggcccttccaaacatggggcttgtgtgatggcatgtgttgtatacttgagaagccacccttgctgtcaccactgtgtatagactagctttggattagaaatactctgtcagaaattaaatgagtttcaagtgtttaacttttggccggggtggtgcctcacacttgtgatcccagcactttgggaggccaaggcaggaggatcacttgaggtcaggaatttgagaccatcctggccaacatggcaaaactgtatctctaccaaaaatacaaaaattagccgggcgtggtggcacatgcctgtagtcctagctaccagggagactgaagcaggagaatcatttgaaccggggaggcggaggctgctgtgagccgagatcaagccacttcactccagcctgggtgacagagcgagaccctgtctcaaaaaaaaaaaaaaaaaaaacccaaatgctcatactgtacttctacaaatatggactctgaaatgcacattcccaagcatttgtaaaacaagatttttcgagttcccatttataattgtagtatagtttataatatgagctaaatgcctgtcagtttagacaacctgatatactcaactgtgggacactttgagagttcttaaaaatacagctaatggccagacacggtggcccacacctgtaatcccagcactttgggaggccgaggcaggcggatgacctgaggtcaggagtttgagaccagcctgaccaacatggagaaaccctgtctctactaaaaatacaaaagtagccaggtgtggtggcgcatgcctgttatcccagctacttgggaggctgaggcaggagaagcacttgaaccaggaggcggaggttgtgctgggccaagatcacaccattgcattccagcctgggcaacaagattgaaactccgtctcaaaaaaaacggaaaacacaactaacttatacaaattattctctgtaagagaaatttcttgttggtttatgacatttgagttaactaaaaaattgggattgaaccagaaaaattttgctcaataactagattttaggctgggtatgatggctgacgcctttagtcacagcactttgggaagccaaggtgggaatatcgcttgagcctgggaatttgagaccagcctgggcaacaccgtgagacacttgtctacaaaatttttaaaaattagctgagcatgatggtgtgttcctatagtctcaggtccttggaaggctgaggcaggaggatcgcttgagcccaggaggtgggaggctgcagtgagccatgatcataccactacattctagcctgagtctccaaaaaaaaaaaaaaaaaaaaaaaagtatattgggagaatggagaaccagagggtgggagatattgaaaatcatctgtagtgagttgaagtccatagacagtgtctaaatgagatatatccagaaaaagtagtaatcaagagctgttgactgtttggaagattaccttgtttattgctgttcctcttaaggtatttatattagtacagcacacctgcatcagactggatttgtggctgtcacatgcaaatggaggaaatttaagactttttttttttttcacaattagagacaaaaattgcgaagaacgtattaaacttcactaatacagattattttattaaaatatcatgtcaaataatggtagaaacatttagagagatggaaataattacaaaagactgctaaaagaagttggaacaagttgggggatgtttaattatatatgcatatttgatttagaacaatttaaaacatttcaataacgtaatatagaaacatgttcatatacaagaggaaaatgtacattgcaaaatagtatatataatatgaccatcttttttttttttatttttttcccctggagacagagtttcaccctgttacccagactggagtgcagtggtgcaatcatggcgcactacagcctggacctcctggggtcaggtgatcctcccacgtcagcctcccagatagctgggactacaggcatgtgccaccatgcccggctaattttttgtagagatggggtttcgccatgttgcccaggctggtgttgaactcatgggctcaagcaatccacctgccttggcttctcaaagtgctgggattataggcatgagccactgtacctggcctcatttttgtttctaaaaagaaatgaaatgaaaaattttggacagataaacactgaaatgttaaagggtagtgggatttaacatgatttttattttcttttttgagacagtctccctttttcgcccaggctggagtgcagtggtgtgatattggctcactgtaacctttgcctcctgggttcaagcgattctcctgcctcagcgtccggagtagctgggattataggcgcccgccaccatgcccagctaatttttgtatttttagtagagacagggtttcaccatgttggccagcctggtcttgaaatcctgaccacaggtgatccactccccccagcctcccagggtgctgggattacaggcgtaagctaccgtgcctggccgtgatatttatattcttatgttttatattactttttcgttttttcagagcaattaccctgtattactttctcataatcagagggaaaaaatttcattttgaaaaaagtagtaattgtgacataactttaagcagggactatatatctttttatttcaaacatccaccacaatgcgtagcatgtggaagatgtaaatatctgcacatactgaggaaaggtgtgtgtcagtgagttgcttctttgcttaataaaagcattccggccgggcacagtggctcatgcctgtaatctcaacactttaggaggctgaggcaggcagatcacgagggcaggagttcgagaccagcttgaccaacatgatgaaaccctgtctctactaaaaatacaaaaattagccaggtgtggtggtgcgtgcctgtaatcccagctactcaggaggctgaggcaggagaatcatttgaacccaggaggcagaggttgcagtaagctgagattgtgccactgcattccagcctgggcaacagagcaagactccatctcaaaaaataaaagcattccatggccattggcaaagcaaaataagctatctaagaaacagtgtattataaaaaatgcttcaagaattaaatgaaaagcttaggaattatgattgtcagagagaagtgagaaaagaaaatgcaaaaagcaactggtaactgttatttagttttcttttgcataagtaatacttgcactgtgtgtgtgtgtgtgtgtgtgtgtgtgtgtgtgtgtgtatgtataattttttttttttgagatggagtttcactcttgttgcccaggctgcagtgtagtggcgtgatcttggctcactgcaacctctgcctcccaggttcgttcaagcgattcttctgcctcaacctcccaaatagctgggactacaggcacgcgccaccatgcccagctaatttttgtatttttagtagagacggggtttcaccatgttggccaagctggtcttgaactcctgacctcgtgatctgcccacctcggcctcccaaagtgctgagattacaagtgtgagccaccatgcccagcctaatgtatacaatttttaaagcacagagaagtatatagtgaaaattcttccccttgctatcagatcagcacactcttcagaggcagccattgttattcttgtatatccttccagaaatacaggatattaacagtacaacaaagaatttcattgtttacacatcattttatgcttatgtaagtttccctgtaggataaattcctagaagtagaattgctgaatcaagggatacctgcatttgcaatttttgtagatttggccaaattgccctccaatgaaattatattagttaacacccccaccaccaatgtaggagagattttatgtaatttcctaggtatcattgataatgtttaagaatttcttattgccaggctgggcatggtggctcgcgcctgtaatcccagcactttgggaggccgaggccggcagaccacctgaggtcaggagttcaagaccagcctggcctacatggtgaaatcctgattctactaaaaatacaaaaaaattatccaggcgtggtggtgggtgcctgtaatcccagctacttgggaggctgaggcaggagaattgcttgaacctgggaggcgaaggttgcagtgagccgagattgcaccactgcactccagcctgggaaacagagcaagacttttttttttttttttttttttaaagacaaattcttattgcctatatgagtgatctaatccttgacaaatgagttttcattttcagtatatagtttggtgaataaactcttctctacaacaacagtctgtaccacactggctagagttatagtgaaatatggttaagtactgaaccctttcttagaccctatcagatccaaagatactgaacattctccagtgctatcaaatctttggagagaaagtttaccatagcctttccttccttctctttccttttcctatcttgcttcaaacatagaaagaagtaccatatgaaataagtaagcctttttaggcagttttttcattccttagctgagagtagaagagtgtgctgcaaaagaccttcataaaattgaataggtaacatagcaaaataagctacagtgtggatcttggaatcagacagacttgaattctggttctgtgtgcctcttagctgtataatctttgatatttaatatttataaaatgaggataataattcatagggccctattctacaaaaggacactgtttttgtcaaatccagacaccttcaaagtaaggataaaaacccagggaatgttagttcctttttaagtctgttttgtgatttataaaatgggataaatagtctcttcttcacgagttcttggaataattaagatatacaaacacattggcacgcagagcaccctcagtaattgtgaattattttttactgttactgcagtcatttgatgtctgttgaaggaattatagcctgcatggacttactgtgcactggaaggaagggaaatctgctacctggtgggttaaagcattttgctttaaaaggtcgttagtagaaggcaggctgagtgctgggtgcgctcaggtgtgactgactgcaggacaccaagaagaaatggggtttgaagtaacagctccctttatccaagccgaaaactgtgacgcaaacagtgctttctaaatcgctgtgaatggaacaacctattagggaaagtttccatctggagtactggtaatgaactcaaatgagagtaaactgctggaaaattgcaagagcaatggaaaataaaaagggtgcctagattgaatgagttaaggttgtattatactttagttcagaaacaagttatggtgactggaaaaagtttaagtaattaattctagagtaaactgtgttagattaaatttattggagggacagctcaaattctgtattaaatctgtgtaattctagatctagggtcaagatttagatgagctctcatcgtctaatcccagtagaaattcccttaagacaattaggacctgagaaactcctagagtaagtaagaaccattccaaattgtaagaaacagtattttctgactgtataaaatcttgtttttcattggcctgtttatctttgcccctgccatttgtcatgttggttctctttacgcattacagcttgaaagtcataccctgatagctagaattttagactcttcagttaaattcaggcaatattaattgcatgcctattgggtaccaggcagcatgctaaatgttaggcatgtaaagacaagacgttgtccttgccctcaaagtatgcatagccttggcaggtggtatcagtgatactaacgatggtgataatctagctaacattgatgaagcacctgcaatttactcaataacagttcttggtgctttgtatatattaactcagtcctcacaagggtcttgatgtaggtattaatagtattatttcattttacaaatggagaccctgaggcacaaaaattcgagtaacttgcctaaggtcaagcgggtgagaatttggagcaaagccctcgattctgctatgccagacagttcctgagttatttatgctttggtcagagcttagcttattaaaattatgatttttaaaagcccacttttctttaaaccttaaatatacttaaaaattcactgaaaaatttagttgggtgttaatattaaaaatgcctatttgcttgttttttgactgatgctcaagcgcttttacatttgacagatgaaattcctctattaaataccatttacaggctgggtgcagtggctcatgcctataatcctagagctttgggaggctgaggtgggaggatcacttgaacccagcagttcagggctgcagttatctatgattgtgccactgcactgcagcctgggtggcagagcactaccctgtctttaaaaaaaaaaaaaattataaacttgactagaattccttaaacatttcaaaacatgcttacaaatttaatatatctgatatccccaggcacttcaaacttcttccagtaaatcaactacataactttaataagtcaaatagtctcttaagaattttaaacatttgaaaaaccagaacatatactcatgagtgtaatggttacaaaaatgatgattacacttgcttaaatacaacttatacaaatatatcactaccatttattcattcaggggttacaaatttacccaaccaaggtggacaaaattaccatttcgaacctgctatagagttttgggggtggagatttaggactgggtcaataactttgaggcttatttattgggctaagctctttcatagtggtgggattgtccaagcctgtacctcttgtgcttacccaatttttgaccacaatctcttacctgctctagagggaatggaattctgcagaccctactcaaactgtgtctttactgactgatttgcactgatagaactgtgtctaataaatactcatgtaataatttggattgatttataacacttacaaattattggaaactcatgtatgtcataattccataccgaggaccatctctagcacaaatagtacctttgtgtgaattaacagaaaggtgcccggccggctgcagtggctcacgcctgtaatcacagcactttagaaggccaaggagggtggatcacttgacatcgggagttcgagaccagcctggcgaatgtggtgaaaccccatctctactaaaaatacaagattagccaggcgtagtgctgcacgtctgtaatcccagctactcgggaggctgaagcaggagaatcgcttgaacccgggaggtagaagttccagtgagctgagatcatgccactgcactccaacctgggcaagagagcaagactccatctcaaaaaaacaacaacaaaaaacaaacaaaaaactcagaaaggtgcccctctaggtagatgaattacaaaagctcaaagttaagctcaccccaggcctggctggattttaatctctacttgcccccttacagcttttaagatttctccccttttaagtaccattaagactgatgaatcttaactgaattgtcagattgtcatttgagcctttaaactggctcctttgtagactttctgacagaaacaagatctagccccatctagattcccacgcccccaagccccccgcttcccccaaggctagaatcagctattctccatggagccagttgcttttgtggtagaatagtattaggtactgttagatacattagtgatttcattgcatatcaaatttttctgttggattactgatacggttctctagtgacaaagctctaaaagatctctttttaatgggtcatggtgtttccagtgtaattttaatcctttaaaaatcttttcaatatttcaatatttcaaaatattgaaaagatttttaaaggacttatttaagtcctactatgtggcagacagcattctaggcacagaggagacggcagtgaatcaggtcatgtccctgccttcgtggattcagtatctaagtggggagcagacaagccttacatctaccccccacttattttcaagccacaagcttgtttcctgtgtcatttgcaatacttatttgccagttttgatatatgctgccatgccaagcggtgtgattaaattacagtgtcgtctaaactttctatgatgtaactggatgtgtattaaccaattcgatcctggtcttgaagccaggcttcgtttgtaatcattcagtgcctacttgatgatccttctatagttcaagcattcaatagggaagacagcgaatggaggccagttcttcacattgcctcactcttgcccgtagcctcctttcctgggtgttactcctcagacgctctgctggcccctgctgcttcctgccctgttgtttgtttcttccttttgtttcctccatccaaaagccccaatctcactgcaacatagggctttttttttgggcggggggtactttgtcatatagttttgtttcctttttttttttttaaccaggttaaaaaagggtgaatcaaacacttttctccttcaggttctcttcaagtctggtgttaagttctctcagtggagtaggtatttgtgaggcccaacaatacttggaaaggttttattccttaagcttggtggtaagaacgtggatgtttgttttcttttacgctgttcgtcgtgtctgaaatcttttgtaataacttaatgttttaatgttctggtctgataacttctggaggagtggcaaaagatggattattaacagctagtagacgaatgcatgaagacgtacgatggaggatgtcattaggtgtctactatgtggcagacagcgttctaggcatggaggagacagcagtgaatcaggtcatgtccctgccttcttggtttcagtatctaagtggggagcagactaagcaaataaatatgaaccaaaacatcagatgctggcaggtggtatgtatggcagagaaagggcatagtgactgggcaggggaactgttttagatagtggtcagcaaaggccttgtgaggaggtgacatttgagaagagacctgaatgaagtgggggataatgagtgtgaacatgtgaggaattgctttccagaagtggagacaggaagagcaaagactcttcttggataggactgtgtttgataaacagcaagaagtgcctagagaaaggcaagccaggctgggcacagtgactcacacctgtaatcccagcactttgggaggctgaggcaggtggatcacctgaggtcaggaattcaagaccaacctggccaatgtggtgaaaccctgtctctactaaacatacagattagctgggcatggtagtgggcacctgtaatcccagctactcgggaggctgaggcaggagaatcacttgagcctgggaggtggaggttgcagtgaaccaagttagcaccattgctctccagcctgggggacagagcaagaatctgtctcaaaaaaaaaaaaaaaaaaggcaagccgccaggccaaaatcggtgggctgtggcaccataaagatcctcacgagctgctctagtggggaggtttgggagagttttgagcaggggagtggcagaatcttaccctttagaaaagattactttggcttttctgcaaaggacttactgtggagagcaagggtgagacaaagagatcagtaagctgttgtaattcaggggagaaagaatagtgacttggaccaagagggtagaggtatgggggtggtgagaaaaaatcagattctggatagaaaaagagaagaggtaaggatgaggcctaggtttttggcttgaacaactgggtagatgttaatgcatccttcccctccttaaaggaggaacatatttagagaaagaaagtgtgatatgcttggtagacagccagtggagatactaagtaggcaattggatgtataaatccagaattcagaggaatgatctggagggagacataaaagatcaccagcagatagataatgaaaattttgagacaaaatgagatcattactcaaatgaagaagtatagacagaagaaaagagatccaaaagtggaggttcaagagtgctctgatttttagaggtcaggaatgagaagctagtacagaggattgaggtggaatctccactaaggagaaccaggaaaatatggtggaagcaaggtaaatatactcttctttcctttttttttttttttttttttgagatggagtctccctcttgcactcactgcaacctccaactctcgggttcaagtgattctcctccctcagccccccgagtagctgggattacaggcatgagccaccacgccctcctaatttttgtatttttagtagaggtcgggtttcaccatgttggccaggatggtctcgatctcctgaacttgtgatctaccacctcagcctcccaaagtgctgggattacaggcgtgagccgctgtacctggcctgtttactcctttcttaaaaggatatttacggccgggtgcagtggctcacgcctgtaatcccagcactttgggaggctgaggcaggcagatcacttgagcccaggagttagagaccagcctgggcagcacggcgagatcccatccctactaaaaatagaaaaacttattcagatgtggtggcatacacctgtagtcccagctactcaggaggctgagttgggaggatcacctgagccagggaggttgagactgcagtaagccattatagcaccactgcactccagcctgggcgacatagtgagaccctgtctcaaaaaaaaaaaaaaaaagagtaatgaaatactgaacaagatgagggctaagaatcattgtatttagcaaaatgagaggtcatggagatcacaagaggggttctattggacaagactaatttggagcatgtggaagagaaatgaaagttgagcaagtggggacagtgaatagagacagctctcctaaggcttttggtgtaaagagaagtaaagtagagtgatagcaggaaccagataggggacatggagaagtttttcatttttaaagatgggaggtatttcagcctttgggtgtgctaatgcagattatctgggagaggaaagcctgtgatgatggaggcgtctcaccatgtagcattctgtggcctcctcccaatcctgtggaggtggcggttaagggaaggaatagttttaccaggagcaactattaaacatatgatagaatgaatcattggaaacaatggaaatatctaacacagaggaatttaaatacactgttctatagccataattgttagatatgcataaattgaactattcagccactaaaaatcgtaataaggttctatattgatatgaagagactttcaagacttaagtgaaagaggtaattattgtgaaaaaaatatgtaagacacacacactttggaaaaaaatgtctgaaaggtagtattatgaatgattttcaatttttccattaggttctaattgttttccaaattactcccccatggattctctacaacgaacatgtgttactcgtgtggtttttttcttaagttattagtatgtcagtgagttcaactctttcatagcaattataaaatatttctatattttgacttttttagccattttatttcaggttttcaatcttgcatttttgttctttttttttttcgtctgagacagaggcttgctctgtcacccagactagaaatgcaatggtgcgatctcagctcactgcaacctccgcctcctgggttcaagcgattctcctgccttagtctcccgagtagctgggattacagacacccaccaccacgcccagctaatttttgtatttttagtagggatggggtttcaccatgttggccaggctggtctcaaaatcctgacctcaggtgatccgcttgcgtcagcctcccaaagtgctgggattacaggcatgagcacttttgaattcttgttttgagctttgggttatattaattaatccattcaaccaatatttaatcagtattttccatgggttgataattgttttaagctttgggaatacaacaataaacaataacagatgagaatccctgccctagtagaactttctttctagtgggatataagataataaacaagataaaagtataaatttcatactgtttcttaggtagtgagttggatttaagacaggttgtggtgtggccaggcaaataagatgaggtgagaggggaaagggagttgagggtctgattagaattattgacagtagaatgaatgaaagctagactgggaaggggcgaagggcgcatgagggtgtaggaacagtggattgaaaaccaggcaaaggcttgttggaattggtactaacaggagggatctgtaaagatataggtattggctggagaggggatgtttggaagtgagataatggataggttgtagtaattgtgaatgacaaggtcaatggagtgatcatagaagagagtgactaagttaagattgaaaatataaaacatgagaagagacctttgcttctccctatggtggagtaacagggcccagattttatgccctttccttaacaaggaaactatgcagaatatcctgaaacagtggtttttagacactagacaacaggcaaggcgggagagaaggcagtgcttgggagaaaagtgagcccccgtgattgtcccagctgaccgactggagatcacagggcaaggagggacaggctaaatggagccccacagcctccctgacgaaggagacagagtggagaatgtaaggaaaccaaagagagtagaattcccagaaccttggaagaatgcactgcacacctcccagagaaatgcggcgcattcctgagtcttcagcagagtcccgtcgaatgtgtgtgtgtgaggagaccaccaaggctgctgaaaaataagggatggccttggagtcccgggcttcttgtggtgagtcgatgaaattagtcctgatggtgctaagacagacaataatggagaggctgtgagtattgaggggcagggggaggagtggtcttacccgaaacgccagagttctggcgctttcgctcgattttgacaatgagtgagacctgtagggtgatagtcttgctcccacagttccctcttgacttctgctgcttcccttgactcctgctgtaggaaacagagtcctgccgagagttggacttcattgttaatcatccgggttaaagggcaacattgtcggtgttctcctttttctatggactctttcccccagaatacaactctatggtttcaaaacaggagtcattgaacaaaatattttctagcaaatttttgagaaaatactggttcctagaggtaagaattacttctgccgtgtatgtgtgaatatatatgtgtgtatgtatatgtagtaatcttagccaaagatagttgcctatggttagatcaattcctggtaaagaaggttttgaaggccaaattagaattctttaaggtcagagagagttctgttcatctttgatgaatgtgtttaagtgagacgtggcattctgagtgagtgaaagcgtcataggaatttcatcatgggactgaagcagccacaattctgacttcttatataaacagacctgtgaaactgcagtttctaccgcgtcagctgggcgtgctgatttggaactttttcttagggtttgtagttgttgagatgaccttttagattttggatcaggttaggaaatgatagtaatagaaggttcttagtaagttagtcattatttcatatgccaagcattgtgctgagtattttatatgtaatttatttaatcttcaaagcagctctttgaggaagatcctatcatactttttttcctgtgtttaaactctttcttcttcatcccctattgtcagctggtgaccttatagacaaggtgtccccctgctatggtctggatccagtgatgttagaactggatcctataccggcttaaaaaactgattgtgcttatctctttccaactctgtttagtgacactgttaataacttgggatcagccatggtaggaatacttacaccatggaaattgccaaatgctacaaatcagctttttccagagagctggctgttaaacttttatcatcacaccaccttctgggtcctctcctgtcttacccttagttgattcatgtattagtccatttgcattgctgtaaaggagtacctgagactgggtaatttataaagaaaaaaggtttattttggcatatggttctgcaggctgtacaggaagcatggcactggcatctgctcctggtgagggtctcaggaagtttacgatcatggtgaaaggcaaagggggagcagatgtatcacatggcaagagagagagcaagagaaaggaggagaaggttcagactctttatttttttttgagacagggtcttactgtggttgcccaggctggagtgcagtggcatgatttcagttcactgcagcattgacctcccgggctcaggtgattctcctacctcagcctctcaagtagctgggattacaggtgcacaccaccacactcggctaattttttgtattttttagtagggagggcgcttcgctatgttgcccaaactggtcttgaattcctggactgaagcaattcacctgccttagcctcccagagtgctgggattacaggcataagccaccatgcccagccaaggtcccagactcttttaaatgatcagatcttgggtgaactgagcaagaactcgcccaacactgggcctggcgcagtggctcatgcctataatcccaacactttgggtggctgacggcaggtggatcacctgaggtcaggagttcgagaccagcctaaccaaaatggtgaaaccccatctctactaaaaatagagggtgtggcatggtggtgagtacctgtaatcccagctactcaggaggctgaggcaggagaatcgcttgaacctgggaggcggagattttggtgagccgagatcgtgccattgcactccagcctgggcgacaagagtgaaactctgttcccccctccccatccccacaaaaaaagaactcacccaacaccaactgaatagcactaagccattcatgaggagtccacccccatgatccagtacctctcactaggccccatctccaacattggggatcacatttcaacaagagatttggaggggacacacatccagaccatgtgatttccattaaacaacaaagtcagcaaaaggatggaatcattaaaaattatatataccctaaatattattttgaaataaaacaaatttgcaatcatttgacaaacttgttttgattataaaaatgtgcaaaaatgtaaaaattgagactagtataatgaatatacatatattttttagatgtgataatttttaattttttgaaccatttcaaagaaagttacagatatcatactttatcctaaactgtttttgcatacttcttccacataacctaattccatcatcactcttaagaaaattagggtaccctaaaatcattgactactctctccatattcacattttcccaattgttccacaaatgtcatttgtagttggttttcttctaacaaggatgcaatcaagatttttgcattgcattgtgatattatgctttttttggtgtctttaagctagaataattcctctcattttttcatgacattgagtattttttcatgatactgactttttaataagtttaaagtatatataaaagtagagaaaatagacaataaaccacaatatacccattaccaattcaataactatcatggctttgttatattggtttcatttatcttttttctttgcaaaaatatttcaaaacagattcaagacataccatttcatgcctcataagtctaagcaataaagtcattttgtgatgtaaccaaatacagtactgtgataataccaagcaaaatttatttttatttttatttttattttttttgagatggagtcttgctctgtcacccaggctggaatgcggtggcgtgatctcggctcactgcaatctccgcctcccgggttcaagcgattctcctgcctcagcctcccgagcagctgggactgcaggtgcgtgccaccatgcctggctagttttttgtatttttagtagagatggggtttcaccgtgttagtcaggatgatcttgatctcctgacctcgtgatcgacccacttcagcctcccaaattgctgggattacaggcgtgagccaccgcacccggccgatattggctttttaaagaaaccaagctagttgttttgtagagtgccctacatttggggcttgtatgattgttttgtcattgtatcatttaactcatttatctatcccatgtatttcctgtacactggaagctagatccaaattcctgactacattaaacaccttcatcagtaatactttataaaggatgaaatatattttggtgtgcaatactttaggtggtacatatggtctggttatccactactaatgattttaaatttgatcacttgattaaggtagtgactgcagttggctccgttctattttatttattttttatttttatttttgagacagcgtctcgccctgtcacccaggctggagtgcagtggcgtgatctccgctcgcggcaacctccaactccctggttcaagcgattctcctgcctcagcctcccaagtagctgggattacaggcatgtgccaccatgcccggctaatttttgtattttagtagaggtggggtttcaccgtgttggccaggatggtcttgatctcctgaccttgtgatccacccacctcggcctcccaaattgctgggattacaggcgtgagccaccacgcccagccaagttggctccattctagagataagctttcttctttgggattagcaatgatctgtggagtgatacttcagcaccacacaaatattattttctccatcaacctctccccctaatagttttagcatctgttaatgttctttgcctgaatcaatacatttcaacaggcattggaagatggtgttgccattcttctgaagtaggacccaggcattttctttgagttgggcttactgattcgtgtttcatacaatagtgcatgaatcacatccgtagtatatcttctctaagttatccaaatcttctctaaatctgagttttcacttcaagtggaacaagcaatgcaaagcattttcaaagcaatacaagtgcagaatcttcctagatctgttttctcttaccccctcctaattcaacagcagggatttttttgtttaacagcctgcttttactgattctttctgaaagattcatcatatttgctgtgggttgaatgtgtctcacaaagttcatgtggcgaaacttaatctccaatgcaaacactgggagatgggggtctaataagaggtgattgggtcatcaggttcctcgtgaatggattggtgtcattatgtagttaggttagttactgtgagaatgggcttgttataggagcaagttcagtcccctcttgctctcttgcccttctgccatgggatgacacagcatgaaggcccttgccagatgtgggcccctcaatcttgcacttcccagcctccaaactgtaagaaatctgttcttcataaattaacctgtcttgggtattgtgatgtagcagcacaaaatggactgagacagtgtccgtagaaacaacttttctattctcttaagtttttataatacttaaattacataattgcagcatcaagtacaaatgtcataaatatttttggaggctgggagtagtggctcatgcctgtaatcccagcactttgggaggccaaggcgggtggatcgcttgagctcaggagtttgagaccagtctgggaaacacggcaaaactgtgtctctacaaaaaatacaaaaatttagctgggcatggttgcacatacctgtagtctcagctactcaagaggctgaggtgagagaattgctggagcccaggaggtcaaggttgcagtgagctgtgatcgtgccactgcactctagccttagggacagagtgagaccttgtcttcaaaaaaaaaaaaaaaaaaaaaaaaggtttggaaacagaaataaccaattcttagtaaaatttctacttaatccaggggagtttagaatgcagagtactagatagcagtctattagacaaaagcattcagtgtgctgtgggcctcagtcagtgtgttctacagggagaatggagtgtgttcattagcacattgttacatggaggtcagttaagagaagagtctaacatgttgtaattttccttgcctgtcttccttggtcgacttccagttccttgacagtaaggaaatcagtcttgtatgtgtttgagtttaatcgctggtgcatggtacagtgcttagcatatagtgagtgctcaagaaaaatacttgttgaatgaattcatgactggccatattgacctcaagtgaattctaatcataaacatggaaacctttgcaatatctttaaaaatgtcaaggttggtatggccattgcacataatttattatttcattggcttttccccttctcattccctcagtctttgagtctttctctgctctgtgccaacttccttcaatttattgtgtattacaagctacctgtgtttattatcattccagtttcctgacaaagatgcaaaaagaatgtgtagcagtttggctgcaatggcgctctgcccaaagagagatgagattcttaggaaaatacaaagtagttccttagttctctattctagagcttaaccaatcccaggaactgaagtcttctgtttcttcacagaggaaatatgacaaaggcagtggctgtacaagcttccttcatgggccgccctccccactgcctcatccagtaagcgggagcaactacttctagaggtgagaggggagggaggacaatctccataacccattcgatgcacccagctgcaaaattttggtattgagaaactgagcaaacaatttgtagagttgctatattgaactttaaagcaaaataagcctacataggattgaatgctcaggtgatacaaatgatggtctttgatagaagcctacaatctatattttgaaagaagctacttatagctgtataattccaataatcccaagatcctgtttctatagatattaaaaggtattatgcatgtacatttgagatgatttttagcttcctaacccatgagaaagttcatcagtaatataatcattatcatttattgagcacttactatgtgccaggcactatttaaattgttttttcatttgatttttcaatttttatagtaaacatagggtatatctccatttacagacggtcaaagtgggaggccatgagaaggtaaatgacttgctctcagtcacacaggtagtatgtaacagagtcaaagcatctacacccatacttgtctaattttaaagttcttaatcactgatagtatgcctagggtcctgtcacatatttgagctcttaaaatctgtgccttttttgatgaggggtcagtgaccgagagcagcctagatctgctgaacattgtatcaggaactgaggtgatgttccataaggcatttgtagtgcgtactcacagaaagcttaagacagtttgtcatttttaccaaggaccaggtccctcaaaaggatggtctgtttctaaggttctttacggaagcaaatgaatgttgagttcttttggccattcattcgctcatttattcatctagtcattcagtaaacacttatctttttttacttgacaactcattgtatttgagtatcagagtctcggttttcaggttgaattcatgttttgtgtttataagaagataatgaaaattcttgaagacattctcaagcacaacagaggaaggagcacagggtttgatttctacttgtttttcaagtgggcttcatctgagaacaaactctattgtaacctttctagaatttggtgccaataagagttaaaataataaaatcagtacaattaaataggaaatgagtgtcttttatgtacaaggccttagattaggtaacaacagttggtcattcctctgggaaatggttgctaaaattataatcaactggcagtcactgattggccttgtttacttcattgtgtcccaggaaaaaaaagacaatctcctcttatgacaagatcttgcagagataataccatttccgccataatcttcatccccctcccattttcttctttcttttctttttctttttctttttttttttttcttttttttttttttgagacagtctcgctgtgtcactcaggctggagtgcagtgatgtgatatcggctcactgcaacctccgcacaccaggttcaatcgattgtcatgtctcagtctcccaagtagctggcattataggcgtgtgccaccatgcccactaacttttgtatttttagtaaagacgaggttccaccatgttggccaggctggttttgaacccctgacctcaaatgatccacccgcctcggcctcccaaaatgctgggattacaggcatgagccaccgtgcccggcccccactcctattttcttaagattaatttgagctatttagttaagctttattaaaagtattggccaggcatggtggctcacacctgtaatcccagtactttaggatgctgaggcaggtggatcacctggtcaggagttcaagaccagcttggccaacatggcgaaaccccatctctacttaaaaaaaaaaaaaaaaaaataggcgggcgtggtggccagcacctgtaatcccagctcctcaggaggctgaggagaatcacttgaacccaggtggcagaggttgcagtgagctgagatggtgccactgcactccagcctgggtgacagagcaaaactccgtctcaaaataaataaataaatacataaataatctaccagacactgtgctagtttctaaggctttagatgtgaaagagaacccttccttcaataatctcacagaggactaaaaattcagaggagccaggcacggtggctcacgcctgtaatcccagcactttgggaggctgaggcgggtggatcacgaggttcaggagatagagaccagcctggctaacacgatgaaaccccgtctctactaaaaatacaaaaaaaaattagccaggcatggcggcacgtgcctgtagtcccagctactagggaggctgaggcgggagaatcccttgaacctgggaggcggaggttgcagtgagccaagatcacgccactgcactctagcctgggagacagagcaagactccgtctcaaaaaaaaaaaaaataatctcagaggagagtgagatagttattaatacagggtaataagtgccctaatggagccaatgaaggctttgtgggaacagtgacaggcaccaaacccagctggtctaggtgaggttaggaagacttccaagatgagatgatgcttacattgaatatttgagggagaataagagtaaagaagccaaggggaggccagtgtttatggcaaagagaacagtgaaatagcatatctagtttggggaattggaaaatgtatgctcttggatggaatgagcaaagctatgggagatgtggctagagaaggatcccatcatgacgggctttgaatgccatcccaaagaacttaaacgttcctaaatgcagtgggaagttatggaagaattttaagcagaggagtaacatgttcagatttggtctttaataagattactatggcatcagtgaggtggccttgaggaaattacattaaagttaggtacattagaagtaatgaggacttggaatttaggtgaactggtgatagggatggagactatgaaataatcaatattggctggacatggtggctcatgcctataatctcagcactttgggaggccgaggcaggtggatcacttgaggtcaggagttcaagaccagcctggccaacacggtgaaacccagtctctactaaaaatacaaaaaattagccaggcgtggtggcacacctgtagtcccagccacttgtgaggtgggagaattgcttgagcctgggaggcggaggctgcagtgagctgagatcatgccactgcactccagcctgggcaacagagtgaggctccctcttggcagggggggaagtcgatatttaggaggcagtcttaaatttagaacctaacacaatgttaggtaccaatatgtcatagccggatgaaactagagggaaaagaggcatctaagttgactttcacagtttcacatttgacctttacagatgtcattagtataaggattagaagcagggaaacaggttttgtgaagaagatgataggtttagttttggacatgttgaacttaagatgcttattggacaagaggaggaggaggaccagatggacagatggaatatttttatatctgaggtttagatgagactgggatggtggagtatgtagattttagggttttcagtctgtgctttatgctccctttgttgtagttactcaattagtgcatcgtgaaaagcatattaccacaaagctaatgaagctaaagcttaagtgctcagatgtgtgggctgcttccaaggccctgggaagacccctagcaagttttacatgtttatgtgtatttgtaaattttgaaaaatcggaaagtttactgtgggccaaaattactctttccacattgagttaccctctcttactcttgtgtgtggcaatgttggagtggtcccaagcatttttgggattcagctgtgggaaagttaagctgtggatatacactttgtttgagtttactgggatatatctctgtggttgcagtcactttgatgtatagttattggtggccatctcactgcataaatgatatccaacaatgtggatgtcactcaaaggtacaagccctgcattgtattgagacaggagtgtgttctaacacatctggcactggaatctgcaagtagaagagcatgaaatgtgtgaaaccaaaaagtggctggtggaaaaactttccactcacccgatgtcttagcctgaacatcagcctggtagaaagacttgcatgcagggaagtttatatggagtgcagtcccaggaagcaggagttcaggacaaggaaagtgaaatgagaaggagggaaagaaaatttaaggatctgatagcgcctaggcagcaggtgttcaattccactagaacctttttaggaacctatggaatggaatgctctcagaactgtctgcttaagtacaaaatgcggggggggcgtgaggggatttatcccgttgatttctccctcttgtttgcatatgcataactgcagaataagtttcaagagaaatcctaaggcaggaagtgaaatattgagcattagcaatgaggcagtgtctgcctgcactgatgcacgagcatgaagccactgcaagcctgcgtgaactagtcactgcggcagtggagggagtgagcactggggcctagggggttggaagtggctttttagaggtgtccaacactgtcagaggaccctattccccttgatccctggttgaaatacacattttctcttgttagaaatatatacattaggggccgggtacggtgactcatgcctgtaatcccagcactttgggaggccgaggcaggtggatcacctgaggtcaggagttcaagaccagcctggccaacatggtgaaaccccatctctactaaaaaagacaaaaaacagctgggcgtgatggtgcacatctgtaattccagctactcaggaggctgaggcaggagaatcgcttgaacctgggagatggaggttgcagcgagccgagatcaccccaccgcactccaacctgggggacagagtgagactccatctcaaaaagaaaaaaagaattaccctgtagaatgcaaatttttaacagtactgcaaatttcatccagaatgccactgttaacatttgtttctagagttttctatatataattatgattaatgcaattaattacaatgaatacaaatgggaacatactataatattctacatgacttttttttagagtagcctttcataacaattgatgtagctctttttttttttttttttttttaaatagctgcatagcattctattgctgatagaatcctactatatccacgctagctgcatagcattctagtgtggatattgtagaatttacttaacggggctttatcgtggatgtttaggtggtgacttttttcttatagaaatataaaaacttagctgagtgtggtggctcacgtctgtaatcccaacactttgggaggctgaggtggatggattgcttgagcttaagagtttgagaccagcctgggcaacatggtgaaaccctgtcactacaaaagatacaaaaattagccagatgtggctacccatgcctgtaatcccagctacttatgaggctgaggcaggagaatcacatgaacccaagaggtggaggttgtagtgagccatgatcatgccactgcactctagcctgagtgacagagtaagaccctgtccaaaaaaaaaaaaagaaaagaaaaacagaaaaactaatttttgtcttctatacattttttaaatttattttatttttatttttatgtttttgagatggagtcttgctttgtcacacaggctggagtacaatggcatgatctcagctcactgcaacctccgcctcccaggttcaagcaattctcctgcctcagcctcccgagtagttgggactacaggcgcccaccaccaggcccacttaattttattgtattttttagtagagacggggtttcactgtgttagccaggacagtctcaatctccagacctcctgatctgcctgccttggcctcccaaagtgctgggattacaaataggcgtgagccaccacgcctggacaatctaaggttttttttaaaaagcttctggtgaagaaaaaacatgtacaaacaattgtgaaaatgttgcaaaaaatttcctctcttgaaatacatccgtctctacaacttaaaggaggatgagttaggaaagccataaacacaaattctaccctaggatcctatttttggttggtagagatgggggtttcaccatgttggccaggctggtctcgaactcctaaccttgtgatccgcctgcctcggcctcccaaagtgctgggattacaggcgtgagccaccgtgcccagcccttctacacatttttaagagctattgggggaaagtagatcatgggaatggtgagtaggaattatgaaggaatctataatagagaacactgggttttaaaagttgtttgcatcttttttctcctctataatgaagatgaagtgcttgaagtttctggggacaggaagcaaaagtaaaatgctaggattttaggacaatgaggaagaccttgaaatattttcaccctttcatttttttttttgaagtttatcatatgcacaaaatttacagaagataattaatacattggataagaatttatctagatgattaattttccttctaatatccagagattttttgggagggggataatcttgatagctcttttcccttatatcacataattattaactatgtaatatatgtttactattaaatgtataataataaataatagcaattctacctcgctccaaattgaggtcatcaggaaggacttcccaaaaagaggagacttgagtgagaaaaggggttaaggtctgtctttcttgttttttttttttggttttaaaaacaaaacaaaacaaaaaaaaccattactttccccttcaagcaggtttaaaaaccgacctcattcctctccttaaaacgcctgtgactgcagcaaatgtacggtgtggtttgatctgcagtgttatttagcacattgtctgggcttaggtaatttttgttcagtgactgtgacaacaggaccacatttttatgtatgacttttgtataattactgatcttgtctacttgtgttgtagaaatcagccaagaaattagcttagttgaaatcagtaagtttggactgtaaaacaaagcttctaaataattattggtctaaaaactaaaaccttataatggaacagaagagtaaatcataaaaccaaagccctaacatttgggcttagcagcagaagtatagatctcttttaaaaatctcctactgatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtctgcagtccggcctgggcgacagagcgagactccgtctcaaaaaaaaaaaaaaaaaatctcctactattggctgggcatggtggttcatgtctataatcccagcactttgggaggctgaggtggaaggatcacttgagtccaggaattcgagaccagtctgggcaacatagtgggaccgtgtcttgaaaaataaaaaataactcctactattattggatatattggaattctactaaacggactactaagtagtctggtcagtcctcgtttatcattcttataaacgctgcaggcctaaaggaaagacagaaatagtctcattggttctaaaataaaccccttagttctatagaagaactacctgtctcttggggaacatgagaaggttcccatcatctcagcctgaaagccatcttttgtcttagccatgttttccattgcccatcacttactagggaaacattccaatgagtgtacagtgagtgttacagaccaccaaaaaagatgaagtggagatgcccagcatgcctcactatttataagaaaatatttccccaaaagatgggaaaatccgagtctttaaatactcagagagagaaataatggaaaaaactcttcagtctctgttctgttggttcatgagattttctcacaagtcatttggatgggccattaagtaagtcacataatgactggaattttctattaattgcctcactttgggtttctggctaaagtatctggcagcaagactgaagaacaagcgaaagagaaaaggagtgggtggtggtgggaatgtgagaccatccattgtttgtttattgcctggaatcctaacttaggggagagggctggagggctgtctttgataggaccatccacttggatggctagaagtaaatgacttggcttcttgtcttttaaacagtttaggtttctttgtttcagagggttactttactttctgtgtctgctgttgtcaccgggaagttcatggatcgaattctctggcatagcgcacacacattagtttgtcttcttatacgcatcagtcattagctgtcttggctttgggaaatgagaacttagtttaatcctagttttccttttgctttctgctttctgttaatccctttgtggtatagatcctgagtctatcagtcaggatccaaccagagaaacaaaaccaataggacacacacacacacacacactctttcatcaagggatttattataagactctagcttatgtattgtggaggatgtttaagaaagcccaaattgataggacaggtcattaggaagagaagatgacaagcaggctggaatcccacaggcacagtctgaagttgttttctatgggagaaatttcttctctccttcagaaagtcttaaggcccggcttttaaggccttccaactgattaagtcaggtctaccaagagtgatctcccttaaagtcaacccatgaagtcccattagggacttcatttgcatctgcaaaatcccttcacaacagcacctagattagtgtttaattgaattaccagggattgttaaattcatcaacacattgggagaagccaaagaggagctgcctggaaaatcatcctgccacaggtgtgcctctgcagacgtttatcaaatcgaggtggggtctctgctactctctccaaaaaccgtttctctcttagttatacaactacctgctgtatacctcacccaggaaagcatggttggctaatctttgtcaggattggacctcactcgggttttcaaatgttgcatgtaaaacaattttttgactgaaaaatgtttttctattgataaccgtttagtgagctttttaaatatttgtttaaacttaaacactaaagcataagggccactgtcaatagaaaactaaggccttattttaccaaggaaactattaaaatgattagtttgtgggtatggctataaaagggaaataggaaggtcattgtggtggtagaagtgtcctatactgtggctctgtcaatgctcatatcgtggttgtgactctgtgctgtagttttgcaagatgttaccattgggggaaactggggaaaagtaaatgggatcttgagcaaaatccacaggatcttcctgttgttccttacaattgcatgtgaatatacaattgtttcaaaattaaaataaaatgttccattttgtaacagcaaaggatttttcaaataatatgaataatcatttcctaattgatctttttaatcatattaaagaagtagacatctatatatatttagccctgtgttgggaattatatatattatatagtattatataataaatatatatattttatttttatatataatacattttcatagaggggggcctcactatgttacctaggctagactcacttttgggctcaatcatcttccagcctcagcctcccaagtagctgggacaatggaggcacaccaccatgaccaccatgtctggctactcaatatgtatttgagtggaagaaagcatacgatgggaaaattgatggtgacagttaagtatagtgttgaatataaaaacgttttgtaaaaatcagggtcaaattattaaatgaaatattgggtatagtataagaagatggagtcttctctctgtaatgatgacttagagaagatagatagcatagcctcaaaaaataatgccagacataaacataaagtataagtacaaaggaaaactctagaaatgtggagagggtagttttaggacaaatataaaatatcttttagctcagaaagttgtatacgttgaaaatatgtttaaaaggtttaaatgcgatttgtagatcactcattcagtaaatatctgcctgcctatagtgtgtcaggcaggtatctacagcttttttgtttttgtttttgttttttttaaacagctcttagttttgtcacccaggctggagtgcagtggtgcaatcttggctcactgcaacctccacctcttgggttcaagcgattctcctgcctcatcctcccaagcagctgggattacaggcatgtaccaccatacccagctaatttttgtatttttagtagagacggggtttcaccatgttggccagcctggtctcgaactcctgacttcaagccatttgcgcaccttagcctcccaaagtgcagggattacaggcgttgagtcaccgtgcctagcctacagtcttgtgtatttcaggaactttcctaacatgtaaatgttgatgtccttgagggtaaccatacctttcccaaatctccattgataaaactgtaaaatctgagaaccacctagattagtttttctcaatgtataatatttctggtcttactgcatggagatttttacagagaagtgaaattcaaccagtcaattttaaaataacactcctggctgctgcatgcactgtgccaagactgtttagccactaatggagaggacttgtctactttgcttctcctggttttaaacaaagtcttttagagggtgaccacctcagtgagtgctacctccctactgtcagagttgttcaagtggccaaagagcagcagcaacactgtcatcgacgctaatagataaattcagggtcctgtccaggagagggccctgtatcaaataaacctctaccctcaccaaaaaatgttagatttttttaaagaaaccatgattccatattccaccagtcagcctcactggcagacgcattagttcaggcctaaccaggagtgaggatgttcatggctggactgaaggaactgtcctgctagggaggtctgggccggccacttatgggtcagactttggaatttttggaagtagtaaaaggaggcttttgtctcccagaatagcaacagttatcatttaaaaccagtggcttctatatacagcaagtgcttctatatatacactcatgtattgtttatataggactattttaagatctgtgtcacatttttctggtgtattttatggtgggaaaattcaattggaaaaaatgtacttagatctggtggggatggtaaggtaaaataagtacttaaaaaaaaaagaagatacacacagtttgtttttatttttattttagctttcagtacagaaatagctaggtgatagtttcctaaatgaaattgtattgcttctccttaagcaggtttgattatagctcgtgttctaatactagattttttttgctttttttttgagatggagtctcgctctgtcagccaggctggaatgcatggcgtgatctcagctcattgcagcctctacctcccagattcagtcctgcctcagcctcccgagtagctgggactacaggagtgcaccaccatgcctggctaatttttgtatttttagtagagacggggttttgccctgttggccaagttggtctcgaactcctgacctgaggtgatccgcccgcctcggcctcccaaagtgctgggatttcaggtgtgaccgattgcgcctggcctctaatactaggttgatctccacagtagtccgaagacttgcaaggcacatatcagcattcatccatgtattcattacaaaaatctgagtgtttgttacgtggcttgtaattcagggtttatttttctttgggttttgccggtgtttaattgagagggaaatggatagagaaatgacttgtctaaaatactattaagagtaatgtgggtatagagtcccaggcattcccatagcctaggtacggtgcggctgtggcagggcagccccagtgggttgtgtgtgttagggcagtgagtgaggggctggggctctataagggctgaccccttcttacctgctctttgtagagggtggcatcaagctaggtgttctgggagaaaggtgagaaacaaggagcttccagtctagcagggaaaagatcacaaacttagtataagaaagagatgtggccagatggcagtggctcatgcctgtagtcctagcacctctgggaggccaagaagggtggatcacctgaggtcaggagttcaagaccagcctggccaacatggtgaaaccctgtctctactaaaaatacaaaaattagccaggcatggtggtgcatgcctgtaatctcagctacttgggaggctgaggcaggagaatcacttgaacctgggaggtagaggttgtaatgagccaagattgtaccactgcagttcagcctgcttaacagagtgagactccatctcaaaaaacaaaaaagacagatgccttaagagaaattcagatgacattataggagctcaaaaatataaaagataatttctacttttgggaatagaacaggcttcctggtatgggtgatattatgtgtggaattaagagcaaggtaaaaaaggattaaaagggctcaagcagaggaaggggtgagtagagccatggaggacctgactgtgaaaagtcaagtctgggcggatgaagcttaagaaggggagagtggaggttgcagtgtggtgatgcctttgagccctgccctaggaacattttctccttaattcagtagctggtgggaagtgagcactgtgcatgcgtgatggaatgctgtggttatgttatggtgagtaagtcttcctttgtgaatggaggagtagagaagaaacaggagtgttggccgttggctagacttggcaggggctgacacaaaggtggatccggagttgatctggagctgatggcctaatcagggagaccatgttgtagcacactgagctacaggtgtgcagataacaagctgtggggtgaggaggcatggagctgactgatttcagatatttgaaggctgctgtcaacctcatccctgcccagatgtctcttccatctaaacgtctctggcttatgtaattgttcctcccgtgacatagtttgtatatcgtacagcatttcccctcagtttgcctcttgtaaaatacaagacccagacctgaactaagattccagatatagctaaatacgggaggagaattgcttctcttattctgaagttgtgctgtcccccagttatcatgacatgccctgttgctggaccagcatgtgatctgtctatgcttaagggacctgctatcaacaaagggaaggggcaggaaagggagccctaccgaaggggccacatggagggtgttcgccttggagcctgaagtctgctgaacctacttagcccctcctcttatcacaacattacctattccccgttcctgtctccagccccgtcttccgcctcacccacccctgtagctgttgtcaacaccctgactcccaccggctctttccggtggtagttttccaggtatacacaaatgtcaagtttcactgagctgtgaaacttatgcagctgtgtgtgtgtacctattcattcattcattcttcattgaaaaggaagaaaaagagaaaagacaaagatttcagagttttaaagcctgggtgattggaaatctaatggtgtcatgttcagatctagggactcaaagagggaggtgttattttgaagaggacagctgaactgtcctaatgacaggccttttctctgtggtcaaggctacttggcagaagcaggccagttcgggcctccgtgttagaagcagaaagggctcgaggggaaagcacactagccagactctagagtcttcagcatgtcacttacactgtggccctcaggcccttcctccaccacagtctttatctccagcatcttctgtcgccaaaatcacctttcgtgacctttcggctgcatttgatacttttgactgctttctgctatttgggacagtttttgtttttgaatgtggcttccaaaacacccattccctttattcccccctccccttcctgctggccactctttctcaagtctctctttggttctatctcagcctcctgacccaggaaactcgggcacccccatgcttagcgctggctcttttcgccatccatggcctaggtgatctcagtgggtttctggctctgctaccatctgtacttgctcagtttttgtctgtagcttacctctgtgtctctctctcttgaattctggactcttgtatctatctgacatttctactaggatgtcaaatttatccaaaaccgagctgacttctgccttctagactgatgccatgcactgtcctccactgggagcggcagctctgttcctctcattgctcaggccaaaaagcaagtcagcctgactctctcattctcctccacccgctatccagtccatcagcaaatcctgctggctctttctgaaacactgtctatccagaatgcaggtacttctcatcacctgcaccattgctcccgggcccaccatcctccctggcttggcttactggtaacttcctgattgggtttccccgcctcagccctttcccagggctattctcctcccacctgctgccaggcctttccctggccatcctgtgttaaatgtcatcccgcccctactgttatgttctccacagcacttgaacacgacccaacatgccttttcacttcaaggtttattcttctattagttttcccagagtctgcttccctagtgtccatctcccctgctcgaatgcctcttgagagccagtgcttgtattttggtccttgtggtatgggcctggcacatagtaggcagtcagcagatatttatggaacaaacaaatgaatttgtgtgactatagttcattgttcatagttcattcatagcccggattttatggcttatatattatgttcatatacattctctcacttgatcagtttgttcacttgtaaatctgactaaatccaattgtaattatatttaaagtgtattgacttccttgactgccaatatgcaaattggcttcctctggagatcttaagtgtagccattaaaagatcatgtcattttttgttagtgacatgggacctaaatttagacttggagagcttttgcttcttttatcactagttctatagaactccctttttgcaattttattgattcctatttattgaattattataattttatgttagtagatcagaaatttaaaaacaaaagcatatcagatgcttcatttgccgtctccttggttagtaaggaggccgcagcatctcacaacttcagggaaacatgaagcattgcattctgtgctaacggtgccccctggagttgtgcaacgcagatgtcatggcgaatgtaagatgtttggcttgagtttctcatgacgggggtctgttttcttcctgctgtttgagtggcattttaggaccccacaggctcagtttgccttgtgcttgcattattgggtcttcttgactactctgtgtcactttttattagcacagctatatcacgttgttcctaattcccttccactacatccattccatcgactttcttccttaatgtctgcctagtcccatttcacttcattgacatcaacattgtctgatagcaaacaagtccatattttcatctggccgttacaggtgtccttgttggcttaatcataataaaaacagttattaccatcaaaatacaaatggtatctgtcatttaaaatttgagcctagaagtatggtaaggttaaaagatgcaaatgtggtaatccactaccattctgggctggtttaccaattcagagagaatatgcaaataataaactttaatttgtggagcagtggaagcaggcagaggtagaaatttgatcccaattctaccttgtatagatgattttagttgcttagtccatctcccagtgcagacatggtttttgtaatttcacctgtgttactgccctgccctgagcactagtggttatagaaagatgggcaatctaggctgttcataatagcttgcttaggattctgaatttgaggagagatgtatttgtaaaaccctgtactctgaaaacaggcctgtttagattcccttaggaccagaaaaggaggagaagggctaggaatttaaataccagaacagttcaaactgcctggtgtacagcaagatctcttacagcttgcaagaaagggcgctctcccaagccctgatcgtgacaacaatttatgctttatttgatctatatgcagtttataaagtttatttagtctatgcatatttaaaagttttagtgtttaatatctgtgattaaatattttgttgactgctatattttcattcttctcgttggaagttaagaatccatcagtttatcatctttttaagttttgggtttattcttctattcgttttcccagagtcgcttttctgctttcagtcctgacttaatttttccaatgctcaggttaagaaaggtcctatttgagctcggttttgaaaatttatgtattgaaaagttgtttatttgggaggcccatgtggatcacttgaggccaggagttccagaccagcctgagcaatatagcgagaccctgtctcaacaaaaaatttaaaaattagttgggcatggtggtgcacgcctatagtcctagctgctcaggaggctgaggtgggaggatcacttgagcccaggagttcaaggctgcagtgagctacgatcatgccactgcactccagccagggagtgagaccctgtctcagaaaaaaaaaaaaaagttgtttacattttctttttgatttatcccttgacaaggactaaagtccctgcagtgaatggttaagtgggaaggtgcatggaatcactgttctccaaaagcctgagtgaaggagagaggtgtcattgtttttcctttgtactgtgcacagggaagaagtttcagaaaacaggacttctcaccaggaattccaaagttaaaagaatgtggccctggggcagatggagaagtttcagccttgaaacaagtgaacttggaggaaaacttaattttcagtgtaagaagcctaattcacaggaataatttctcctagagtaaggccctttccagccaaatctgtcggtgctattgagctggtatttcaagtatgtccatctgcatttaaacgagttgctccaagacaatctgattatacggtagttactttggtgagaatagcgcctcagtggaatggaaacttcattttgagtctaatattagaccttgctttggaaaattccttttaaatgatcacaagctgggaatagcaaaagaatttaactttcgacagacagcattcaccaagaatttttaactgcttatgttgggtccttgggaaagcagatgtgagaaacctaccggaccaagtggatgagatgagaattgacttgacctgatgcagtgtttatatccattgctgataagtttccctcctcgtctcctctgctcaaaatgttttcattctttgagcgtgagcatgctagggatgaagattgtaggatgcctaattgtctaacaatctaaacttctaggcttgtagacacagctgcctagaagggggtctgaggcagagcagaagctgacttagactgccaagttaagaaagggccaacagatctgcaggaccagagccattgtctgcgtaagtgctgggagcttgatcagatgcagccctcagaatatttttaatgtggctggttgtatctgggtgaacttacccaacttaaagtgttaactaaactttatttaaagctcttgcaccccaccccccgccaccgccaccaagaaaacactctgtcattaaacaaaaattatacaaaaattagctgattaggaagtttccagataatgcctactttggcttcatttatggatatgttttagatactttgcatgctttggattgggaaaaccaatattgttgtttgagagatgctgttactattttaaaagatctttgagattgaaatgcatctttttaactttttattttatttttttatagaaatgagttcttactatgttgcccaggctggtcccaaactcctggcctcaagcgatcctcctgccttggcctcccaagatgctgggattacaggcgtgagccattgtgccctgcctgaggtgcatcttctaatcactttgtacatttaataatatagtggggttttttccctctaagttggtaataagttgatggtgccttagaatttaggaaaaacattaataaaataacgagcattaccacttagtgatcacccagccgattccaggcagtgtctttgctgggtaccagcattatctctgattttcacaacaatcctattgcagtaacaattatgaggctggctttaaagataaggaagctcagaaaagttatgtttggtcatggtcttctgctagtaatggctaatgagtggcctgctggagttcaaatccagaactgttcgactcatgttcttcccttgccatcctggtctcaagcaatccatcccccaaagcagcagtctttaacctatttatgcctagtgttccattattggaatgctaagcttgtgggagttatttatattctactgctcaaggtcatcaccaaggtctgatttttcacaaaaacttgcaacctgtgacataaatgggttaaactttttttggtctcaggaccccttgaaactcttaaaaatgattgaggatccttttatttatgtgggttctatcttttgatatttactgtatttgaattaaaacagagaccttcaaaacattggttgatttaaaggacaataatccattgcttgctaatatagtgttattaataaaaatattttctaaaacaaacagtagaagagtgccattgttttactttttgcatgtctaatcaagctaaaaggaaggcagctgggttcagtcttgtgcattcagtctgtgcagtatactgtgttagttgaagtatatcaggagaatctggcctcacacaggtatgtatttggaaaagggaggagtatcagcttttttggacagtgatgggtattctcctttgatattacatcaaaactccatacatagtaatttattaaaggttagttgtaatgtagaatctgaaaccataccagtagacctttggactcttacattaactttgtttggtccgaaatcttctttacagaagaatactgaataatatatgcaggtactcccccttctaaataatacatgtagatactcccatattccaggaagtagagcttaactcccacccttgtatgggtgggctagacttagtgatttgttttcaaataatagaattaaggaaagggaaaaatgagtaactttccaatggagaaacctgggaaacacagccttaaccaagtgatgaaaaaggtgaatgtcagcagtgatgtcatataaccactgatgtaactagaaaacctataacccagtatactcatgggtgaaacatcagacaagctcaaatcgggggacattctgcaggaggcctgaccagtacccttcaatattgtcaatgtcataaaaagcaaagaccgaaaaactgtcacagaccagaggagactaaagagacatgacaactaaatgtggtgtggtgccctgaaccagacaacaaaacaaagaggatgttgtagaaataatcagcgaaatccaaataaagtctggagtttacttaatagtaatgtaccaatgccaattttttagttttgacaaatatatcatggtagtgtaagatgttaacaatgggggaaaccgggtgaagggtttataggaactctctgtactctctttgcaacttttctgtaaatctaaaattattccaaagtaagaatttttaaaaatctgttgttctgtcttatactccaaatggattgtgtactcgtgcatgattttgtaacattgccatagtcacttggaaaatattggttcactgagttatacagatcttcaaaatgttgacagattgcaatattcaatatttttaacaatcgtttgttaatatcaccagcaatctcatcagaaaagtctttaattgttgagaagctgttacgctcgtggctacaagtctcccaaaattttaattttcttttcttttttttcttttttgttgagacagagtctcacttgttgcccaggctggagtgtaatggcacgatcttggctcactgcaacctccacctcctgggttcaagccattctcctgcctcagcctcctgagtagctgggattacaggcgtgcaccaccacacctggctaatttattttgtatttttagtagagacagggtttcaccatgttggccaggttggtcttgaactcctgacttcaagtgatccgcctcccaaagggctgggattacaaatgtgagccactgcgctcagcattttttttttttttttttgagtgggagtctcactctgttgcccaggcctggagtgcagtggcacaatctcggctcactgcaacctccgcctcccagattcaagtgattctcccacctcagcctcctgagtagctggaatcacaggcacacaccaccacatccagctagtttttgtatttttagtagagatggggttttgccatgttggccaggctggtctcaaactcctgacctcaggtgatctacctgcctcagcctcccaaaacgctgggattacaggcgtgagccaccgcacccagctaaaattttaactgtctgttgaaagctcaaattttatcattggcagtccacactgcctattgttttccttgatgtgacaggttcatttttgagaaaatgcctgacaaatacccaagtctatataaccatagtttgtctagtagtcgtgtttgaagtaaaaacattcaacaatgaaagtggccagtccaacttgcaagtcaatcacaagagtctttcctcaggacggctgccatacttcagaattcaacagaagtgttttatgacaattcccatgttgtcatacagattaccaaaagacatgtactcaggtcaggatttaatgaaattaatgtttactgcttcagcaaggacttttttttaagacagtgtcttactctgtcgcctaggctggagtgcagtggctcgatcatagctcactgcagcctcgaactcctggatcctcccacctcagcctcccaggaagctgggactgtaggcctgcatgtccagctactttttctgtttatttttttgtagagacaggatctcactgtgttgcctaggctgattgtgaacccctgggctcaagtggtcttcccgcccgggcctcccaaagctcttggattacaagagtgagccatcgctcccagccaagtacattcttaagagaagctacttccttccctttactgcatgtgtgttgtgacagagaacagtgttcactaagtgcagcttgctcccactacgttcatctgtgctaaggtgccttttcaccatcagttcaaatttcaacacagtgaaaacagccaatagcatcttagtattcttatgaaaatagttgggcctcatggacctcctataagggtcttgggaatccctagggcaccatggaccacactttgagaaccactctctttaggtggcagttgccgaaaggttacgcaacaagagacattaccattaggaagcagagaacaatggtgcagtgcaatgtatgtggagggtgacgctcttctggcgtaactttctgccttttaatggctcttgaagttcttccatttgtttgtgatgtctcagtaccattttaaaatgctgaaacagagattttgataattcgacatctgtgtttgctggtgtttttaccatatcacatataacatgtcattcagaaaattcagaaagtcacttcctaaactttttcttgtctctaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacagtaagtagcattgtctgagtgtatttcccgaaacctttgctttttttgttgtgctgtttgtgagtcttctgacgtttctccagttgctgcctctgtttataatgacacatgatgtgtgtaggccgtgcacaacctgttggtatattccagtccttttatcagaaggagcagaccctgtaatgtcaagcgacagcattcttctgaacagccagctgcttctaaccactgatgagggcattacttgccctaaacagaaaactgctgttggttttaaattttattttacatatgtaaaaaaatctctactaaaatttcattttatacaactaggtatattgttttcagataaacttctgtttgtacttttcataactcaagtactctttaaagtgaatgggaggccgggcgtggtggctcacgtgtgtaatcccagcactttaggaggccgaggcaggtgaatcacctgaggtcaggagttcgagactagcctggccgacatggtgaaaccttgtctttactaaagatacaaaattagctgggcgtagtggtagtggtgcatgcctgtaattccagctactctggaggctaaagcaggagaatcgcttgaacccaggagacagaggttgcagtgagccaagattgtgccactgtactccagcctggttaacagagtgagagtccacctcaaaaaaaaaaaaaaaagtgaatgggatttgttaaactgatagatgacaactgtttatacttccttgttccagaacccttgggtcaggggtggaggtgagatgtgcaagtgtagcttgctggggcagtgggtcgggggtgtgggaagcaggatagggtagggtacacagtaagaatgtgtttttcctgttctctgcttctctgctttctctttgggggaaggtgaaagtggggagtggcttggatcagggcagggtgaggtaagtatggataccttatttgcccaggtgtagacttgatcctgaactgagtgttgaactgagtcctgtctcattaaagtgtaaaatatgattgctggactgtggagcttaaatcttctttggccacacccttagcaatgctcaagggttccataaagccagagatggtccaggcctgagatgtttgggggtcccaggggtgggatagagaaagagcatctgggctctgtgtatgctgcctggttttaaagcatggcttggcggaggggaaatggactgtctgagcttcccaacaagctggtcattcaggataaagtctgctttgctcaaagcagggtgctttttattcagtcctgctagaaggaaacatcccacattttaaaattgagaaagtttgggaggccgaggtgggtagatcacaaagtcaagagatcaagaccatcctggccaacatggtgaaactccgtctctactaaaaatacaaaaattagctgggcgtggtggcacatgcctgtagtctcagctacttgggaggctgaggcaggagaatcacttgaacccgggaggcggaggttgcagtgagctgagattgcgtcactgcactccagcctggtgacagagccagactctctctccaaaaaatgataataataactgagaaagtcactgggcatggtggctcacccctgtaatgccagcactttgggaggccgaggcgggtggatcacttgagttcgggagttagagaccagcctgaccaacatggcgaaacaccatctctacaaaaatataaaaatcagctgggcatggtggcacgcacctgtgatcccagctactcaggaagctgaggcaggataatcgcttgaacccaggaggtggaggttgcagtgagccgagattacaccactgcactccagcctgggcaacagagtgagactctctcaaaataaataaataaaactgagaaagtcttccctgtacccacaaaagaaaaaattttacacttaactaacgactattttctgaaaacgtatcctgttttatcctcacatctgaatagcattcttaaaaaacaccctttcccacatctgttttatcctttcctcacttggagggtcgtcagaggtctcagagaatattatttgtacgtttacgttcttttcatccttcctcacaaatgactgtttaaaaaccaactgtggctgggcgtggtggctcatgcctgtaatcccagcactttgggagggcgaggcaggcggatcatgaggtcaagagatggagaacatcctggtcaacatggtgaaaccctgactctactaaaaaaaaaaatacaaaaatcagctgggtgtggtggcgtgcgcctgtagtcccagctgctcgggaggctgaggcaggagaatcacttgaacccaggaggcagaggttgcagtgagcagagatcgcaccactgcactccagcctggcgacagagtgagaatccgtctcaaaaaaaaaaacaaaaaaaaaaaaacccaaaccgagtgtgtctgtatttctgtttgcccaggggtagtacttaccattaggaaggcgatttaccatttaggagatcctatgtttgcacttcagttttatacaaatgttagtttaacttctcttaagccttgattggactgatctcatacagaagtgttgcctgatgttactggctcaagatgctggacttgtggtttcaggtttttttcttttttttttttttagactaagtcttgctctattgcccaggctggagtgcagtggtgcaatctcacctcactgcaacctccgcctcctgggttcaagggagtctcctgcctcagcctcctgagtagctgggattacaggcacccgccatcacacctggctaatttttgtatttttagtagagacaaggtttcaccatgttgttcaggctggtctcgaactcctgacctcaagtgatccacctgccttggccttccaaagtgctgggattataggcgtcaccgtgcctggccgatttcaggtatattcttgatctggatagagattgggagtgacagctgttgccattagaaaattatttttaaattctgtattgatttctactgtctggttctcaaaagaattgagacagacagaaagtggaagttgcagtcgccttctcaggaaaagcctagtaatcaatctgttttgctttatgcaagaaacaataatgcagtgactcagtccttgggaaggagcaagcaattggggtcttgtctttaagctcgttttttcttgatcattaatttgtctagaaaaatacttgaaagatggttttgcaggagttaccttccaggtcaggaactggtaaaccaaagcccatgggtgcctgcactctgcttctggtgacctgcaagctaagagtgtcttttcacatcttaaaattgttgcaaaatggctaagcatggtggctcatgtctgtaatcccagcactttgggaggctgaggcaggaggattgcttgagcccaggagttcaataccagcctgggtaacatagtgagactctgtctctacaaaaaaaattttaaaattagctgggcgtggtggcacacacctgcagtcccagctacttgggaggcagaggtgagaggatcacttgagccttggagttgaggctgcagtgagctgcgattgtgctgctgtactccagcctgggcaatagagcaagagcctgtcttaagaaaagaaaagaaaccaaaagaagaacaattactttgtgacatgcaaaaattatatgcaattcaaattgcagtgttcataaagaaagtttgattggaaaacagccatgctccttcatttttctaaacagcagtgtggagactatgtagacccacatagcctaaaatattgactctctggcccttttcggaggaagttcgcagacctctgtccggatcccattcgtatctgcttgaccttgaggatctcatggtctggagtagcagtgaagcaaacatattattaaaacactgctctgcgaaagcattcatgtttgtttcttaagggggttttgtttgtgtgttgtctttcagcagagggaaggggcctcttacaggcagggacactcctcccttgtgtgtacacagtggtggtcctttgctggaggatggtgacattgagcaacagtggactgtgcactccaggctgcgcgccctgttgctgtgtgcttctgtgggtcttgtgagaggctctgtcagcatttgcctgatgctgtgctcacaagggccctctacagaccttcctgaagtacattcactaatcaggctgcctgcggtcactcgctgcggactgcgtggtgcccaggccgccgtgctgatttgatgaggatctggctctccctccctccttccccgtggcatctgtgcatagagcgcctgcatctggaaatacagtccagctcttccaatatattttgtctttttcattcaaaaagagccctcatctcatgggatgcatttctttttttttctctcttttaattcctcccttagctgacaacagaacgaaaaagaaagtggctcaccgggaacgaaagcaagatttttctgcctttaagcagacagacagtgagatgaaggttaaaatatcaccacagctcctcctggccatgcaccgtttcctagcaacaggcaagtgcagcttatcacagtttgagatctctaccaaccctgaagcgtgtttctcacccaccactgactggggtgggttgggggtggacactgggaaatggggtgataagtaatgccacttttgtgttttgttttttttgtttttttgttttgttttgtttttttctttttaaattctctcctctcctatgttcagtgtcggcatgaaccctctgagacatttaccaggggtggaccagtaacttaaaattggtctgaaaggtaaggatgaatgttagtgccacactgcatgtgtacagtaggccaggccatctccttccagctaggtccgtgggagagccagctggcggagcaggctgatggtgccagcctggcaccagcttgtttgatggacaattgagtccaatctctcttcagcttgtcctggaagcacagttggacatcagtggtaacacaggggctgtgatttgcaaagaagaaaactaggttttcacaattaaatctttatcttttatgattttaatgaaatcaaattctaagaactttgatatggatttcttgatggcctcctcagatcagattaactcgagtccatttcaggaggcaagtgttcatgttgtttaaaccaccaacccagccggcactgactgctccagagaggtcaaggttgaatggacttaagatactgaccaacccttctcccatccccagatgctctccagggttgagctctggtggccaggggaagtgtgagaaagtctaaagcatccagtggctttagaagacatcggtgtccctgataggcagccagtgcctttcatctgcatgcagtaaacttaaaccatgtttaaaagaaggctagccgcaaccacatggtggaatgctgtttaactctttaaggtcgtgttctcagacacatggaaatgctcacaatattatatttatcacatcagaaaatatagcttaatacaaagtggggagaaacagaatctaaaactatgtgtacattaagattagagttgtgtttttgtgtgtacacacatgtatacatgagcacacgtgcctgggcatggcactggaaagaaatgctcacttgattgctcagaatggtaatctgagtggttggcttatagataagtttttctttcttctttctttttctgtattttctaaaattcctgtaattactatcttattacaaaaaagtcacaagttaatacagaacttacagctttcataaatacataattagaaaataaaagaacagacgatgtctttcacttattattctttttctaattttgataatactgttcctcatttaagtaccacaaattaaaactaaacatctaggccgggcatggtggctcattgcctgtaatctcagctcttggcggggccaaggcaggctgattgcttgagaccagtctggccaacatgatgaaactctatctccactaaaaatacaaaaattagccaggcatggtggtgggtgcctgtaatcccagttactcgggaggctgaggcagaagaatcacttgaacccgggaggtggcggttgcagtgagccgagattgcgtcactgcactccagcctgggtgacagagtgagactccttctcaaaaaaaaaaaaaatttaaattaaaaaaaaagaaaactaaaactaaatctcctactctgcttctgagatatcatagagtccagttgtaggatagcacccttcagtcagtaatttttgtttttgttatttaaaataaaattgctgtctttgtaaatacttttgaacattactttttttttttaaattagcatgttgatgtgtgcacatgccctgctcttatttccagtctcgaccctctttgttccccacattccttggggtagttgagtgggagagggagacgtggggcacctgtgtgtgtgcgctggcactaaccgcacctgatgctcctgaccttggcttcttcctttggctgttggtcgacagtcaggctgttatggcttgttgaggggcatcccccgcactcaaggagcccgcttgccgttgattttcgtttctgtcagtgaaattagtgtacttttatgaggactgaagtcaatgatgggttgaaaaggaaagaagtaaaaggaacaaatgtgagaattcagcactttctaatttctcccaggtaatctgtccccagtggatcaccaaacggaagcctcgtccattcaaatgctatcactttgattccaagtattcttatctaaacacctcaattactattaatagtataatttttctctctctgtttgaaatgtaatatcaagttgtgtttatatctatagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggtcagaagaattattcaatagtggtttgctctcactgagtatccatctttcagtttggtgtaagtgaatgggtgtcaccgtgtacatactgaacctttctatagggggtagccttagacatgggagaattttatcttcctgttttcatatctgtaaagtaattctaatataaagcaatgccaatagttactttaattttcaatactaaaaggtgcttagtaggctcggtgcagtggcacatacctgtcattccaccactttgagaggccaaggtgggaggattgcttgaggccagaagttcaagaccagcctgggcaacatggcgagaccaccatctctacaaaaaatttaaaaatgagctggatgtggtggcatgcacctgtggtcccagctacttgggaggctaagacagggggcggggcggggattgcttgagcccaggaggttgccatgtttgcaccactgcactccagcctggatgacagagcaaaaccctgttttaaaaaaaaaaaaaaagttggggggatgcacctagtgattactgagtcagatgaaaatggtgaattcaattgttagtattttttgaagagtgtgggagagtttaccagtacatgtctgaatctcagtgggtgtttgaaatttaagtgtcatgggttattggtcctttttccatccttttttccatccttcatgaggacttaagtttatacagcttcttagagatatcttagcatctcttccattaacgccatcaaaataatccatttgttgttgtttttattcctggttaccaaccaaactgttttatagaggaactgataggataattacagcctcttacagcagagtagctaattccttctcactgtaacataattcagtagatgaggtgagaaggtcaattcattctaaacttcctttgagtggctttggtgcttgggttgacaggaggccttgttttatcacagtttcacttaatagagctctatccttggcatggaggccaaggtggatattagtcgataaaatgctaatgtggatcaaatgtgtagattcaagctcgggaaagtgttgtgttcatgtgtgaccccatgtttgggcagcattgtggtgtttggaagcaggagtgaggagtaggaaaatgccgagggttagctgattacatgtcacattcttacagtccttcttagaaacttctgtttgcaagtttactaatttagtacgctgattcatcttctaaatttagttttcctcaattgttttttttctttcctctttggagataatgtaagcttgtaactctgagtgcactgttgggaatttagtttatttactgcagtgagggaataaaacattcatgtttctcataagagtgagatgcgaatattccttaagcctggagaaactctggatacatcaaagactgtcacaggaggaattggaatattgacattgtgaattttagtgttaatattagaaactgtggttttcagttgtctacttttatatagttagtgtttatgaagttgtgattcagtaatgctttattgctatataagaaagccatggatctaaaaatcttatggaaaagggacttcataatctctgtccatttacaagtaaatcttttaagatatttttgataagacatctatgtatatttacctgtatttgtataccaatttgtgttaaatacttatataaaggtgacaagttttttgaactgttaggctgataatgccatgggggttttacaagtagtgtgtatgtttgatgaacaggacttacggagatgtttggtgaaaaaccatgatcttgcagacagccagttacctaaggtacaaagagaagagcaaaatgaaacaccctcacagcctcagtcaatctggcatagctgccatcattaacaaagcatattctacctaatatgtcactaagccagcgttggaagttcatgccactttagggagcatgatccactgtggagtttgtttgtttttttgtttgttttgttttttgtttgttttgagagggaatcttgctctgtcacccaggctagagtgcagtggtgtgatcttggctcaccgcaacctctgcttcccaaatttaagcaattctcctgcctcaggctcccaagtagttgggactacaggcgtgctccaccacacccggctaatttttgtattttcagtcgagatggggtttcaccttgttggccaggctggtcttgaactcctgacctcaagtgatccacctgccttagcctcccaaagcactgggattacaagcatgagccaccgcgtctggcctccactgcatttcaagagcactaaataagaaaaaagcaataatatctgccttcccttcctggcctcagtgccagtgagatgctctccctgcaggaaaaaaccctttaagtaattgataggaatataattgtaaatagaaacacatcattttttagttgaagccctagataagataaattccaaattattcaaggaaaatgacctaagtaaacaagagtattttgtaagttaccatgtacatacctcccactacatatgcataaaaaagccaaaacttcaagttttatctgtaaaagtagatttttacaccaaaatgcatttcagaagcaataaagacagttaaaagcacagtaaatcatggaaaaaactttattggctctacatgctttaaataacttaacaaaatacgtatgtaagaaataggaacatgattttggtggaagtgtttttccaccatcatagaagatcaggcatactaaaaaaaaaagtcatagttttaaactgaataccttgtaaaatagaattaacagatttggaggaaattaaacataatcaagagaaatatactttcgaaaaagcttatgtgggctgggtgtggtagctcatgcctgtaatcccagaactttgggaggtcaagataggatcgtttgaggccagaagtttatcagcctgggctacagagcaagatccccttctctacaaaaaattttttaaaaattagccgggtttggtgacaggtacctacagtcccagctgctcaggaggctgaggcaggattgcttaagcccaggtgttggaggctgcagtgagctgtgattgtgccactgtactccagcctgggcgacagagtgagcatgtctcaataaaaaagctatgtgactcataaaaattgatcatttatcatgttacagtgtacatgctagtaaatacaaaaagatagaaatttcatgaaactacctgaatcgatgataatgaaataaaattcgaaataaaaaatacataaaagtgctgggcatggtggctcacgcctgtaatcccagaactttgggaggttgaggcgggcagatcacttgagtccaggagttcaagaccagcctgggcaatgtggtgaaaccctgtctttacaaaaatacaaacatcagctaggagtggtggcagctactcaggaggctgaggtgggagaatcacttgagcctgggaggcagagattgcagtgagccgagatcgtgccactgcactccagcctgagggacagagtgagacccccatctccaaacaaaataagataaatttaaaaaaagaaaaggtcatatattaaaaaatactaagtcatgttaaaattgtgatacattctcttatgtaggtttatattcaagacacagaacatagtgtataatgtactctcttttttgtaaaagaaacatgcaaatctacatgaaatatcttcagaaggttacccaataaactggtaacaacgagtctctaaggaggcaacttgaaaggttgaaaacagggtggaaggaagactgacttcttccttgcatagtttaaatttctcaccatgcgcatgtactatttaatttaaaaatagagctaatgacaaaataaaagtcctaaatagcaactgagttagagaaaacatatagaatgtaataaaatatatatagtattaccataaaagtctattattaaataatgtaaataccatagaggtggtctgtcagttttaagaaatcttattccttacgtacttaaaaagaaaatagaactataattatgtggaaaaagagcaaagcagcaaactaaaaaagaacaaattaataaagattgttatataaactggccgggcgtggtggcttgcacctgtccagcactttgggaggctgaggcaggcggatcacttgaggtcaggagtttgagaccagcctggccaacatggtgaaaccccgtctctactaaaaatgcaaaacttagctagacgtgttggtgtgcgcctgtggtcccagctactcaggaagctgaggcccgagaatcacttgaacccagaaggcggaggttgcagtgagctgagatcgcgccactgctccagcctgggcaacagagcgagactctgtctcaaaaaaatatatataataataatttaaaattgaaaatgccttataaccaacaaacacaatcaagatttggctctttgaaaatatgaacagagtcagtgttctgttggcataattgatgtgataaaaggaaaaaaaagttctctcctctcctataaaagcagctagaataaaaggatttgctagaaaaaatagtcaatcttcaaaaaactcacaatttctatattatagaacaagatggcatgatagtcaattgcattctttaaggctaatatgggcttaatcctaaaatctgataatataagccaatctcacttgttaacattgatgtagaatttctaaataaaatggtagcagatagcaacacacacccagggttactgacttgtggctgtgactgaactgggtttattttaggaatgcagttctagtttaagaacaacaaaaccaaaatatgtcacattaattgggaaagtagtaaaaaaaaatgatatttatatcagtagatgtcagacagttgacaaagttaagcatctattactgattttaggaaacagatgccccatcccctcaaatttttaactgaatggtagacaaaaaagaaaaagtacaataaatcatatcctaaactggtagcctcccatctaaatcattgttttacaaagctatctatgcaaatatatttatagcaaatctattaactataaagtagtagaaacagttcacgtctagctaatcaaagtgagatgataatatgagggatcactatgtagtaatggaagaagtggaaagcatgtgcccggcccatccacactcttttttagagcatctgacatggattcaaaagggacttttccctataaacgggggtcgtcttgtggagtatggcaggtggcatcttaaaatttatacagcccttgaaatacttagtatgccttcacccttcacctgataggaaggagaatttaagcttttaatagcaacctcctcatgggtttttaagttgcacggtctgtgtaccctagtgcagtaacggatccttaatcttgagtcaagcacagataacacacccattttacttggacacccagcattgaaacttttaaaattatactacttaagtatatgtcagtataaaattgactaggtataagattcctttgcttagaactcttatatataactataaaccaaaacaaactatcaaatgaataaattctcaatgtgtagatgatatttggctgacctggaagggccccatcccagggctgtggagggctgctgccctgcgagctcccttgcattcagcacacctgggcctttgtgtgtccaagatgtctgcaccctccagccctttgccaaatttgagctactttgaatgtttctacagtgtgtcgtgctattatttggcctccactgggtgtgactgaattacttccctgttaaatcccactctgttccctactcattagctcagtgcttctcagaatttaatgtgcagaggattcacctgtgggtcttgttgaacggcagatccttcagtatgaaacgaatgcttcagtaggtctggggtggagtctgagatgctgcgttaccagcaagctcccagttgacagtagcaaggcttagctgtgatgctccaagtaataccacgtggcaccagagtggccaaggcgggtgctggcactgacatctggtggtagcacttgattggaaaatggtcagtcagatggtccaaaatgtgtctaaattaattttgaccatcaatatttagaaaagtaaatttagcaaacttgctgagtctggccattccattgcagactccagattgaaagcattgctagagagtgtcggggcaccaggtctccccaggctttgagtgggcatctttgggtgctgcaactcctctctcggttaatacaacccagtctttgtgcccctggcatctcatcacctgctttcaggagtcaggcccccctgaatactttgtgatggcgatttaaaaaacaagaaggtgagcgggagaccaggtggctgctcagcatgtggcgcatggggaagtcccgccttgagccgcatgcactgatcccgggttggcactgtttgcaccagtgtggttgtgcccacgctggctagggaagtttaggattccactttgaagccagacatggcacgggctgttgagtaggttgtggacacttagaaactttgagaagaggttatctgatacctttgtccaaagaagggcaggatgctgtgagagatgctttactcaggaagccaactttgctggtccagtgagtccttcttccaagttcgtcagtttataagcatgaagccctacttccctctgggaattcttggaattcatcatgtcctgtcctggtttttttggtgatatgctcgactagagtaaacttacagatgtttcaaaagtaaaatcaatatgtagcttccttatatggaaaaagttgttatctgaaaggacacctaattaatctcgaaccaggtaagccatctcctcctgtgccctaatttttgtatactggtaggttatttgaaaatgaatgttttttggaaccactaacacgtaaatgaataagatacgtttactggatgtttttaaaacttgcctgccagaaaagcttaaatcctatagagagggatgtagtggggtgggcaggtttgacaactcttggaattgtagagtcatagaatgctattatagaactgaaagaactgcaggtaccctttaatctgttgcaactttatatgaagtaaaattactctaatgtgataactcttcctaagtgctgagatattttaacaaagtttttgccagtttgaggcagaatgagaaaataaagacagttgcgatgagcttttcataaagctatgtgtattcagtttgaagacctattactctgaaatgacatattttctaaatttgaggggttaaatgtctggtcttttatgaaatgatggtaacagtagatagctgttttttttgttttgttttgttttgagacagtgcctcactatttcgcccaggctagtcttgagctcctgacctcaagcaatcctcctgcctcagcctccccagtaactgggattacaggtgtgagctactgtgcctggcaatagttgtgttttttaaaataaatacctttattttgccctggcacggtggctcatgcctgtaatcccaacactttgggagactgaggagggaggatcagccaggagttcaagaccagcctgggaaacatagtgagaccccgtctctataaaaaaatagaaaaattagctgggcatggtggtgcacacctgtagtgccagctactcaggaggctgagttacaagtgttgcttgagctcaggagttcaaggctgcaggattctcaccaccggtgcggtgagccatgattgcaccactgcactccagcctgggtgacagagtaagaccctgtctgaaaaaataaattttaaaaccatctttatgaaaaaaaaatttggcaaccccgtatctttccctgtatctgtctctgtagaggtgcgtcttactggccgttaggatggaaatgtctaggaatcactgagcttagcatatccaccccgcagcagtgaatctcaactagatggagtccagagggaagatggcagatcctcccctgcctgggatcctgtctggaaggacagaggaagcatcagctggaatggcagtggtctggagttttgagtcttgcagccgcccttgcttaatcagttgactcagctacactgcctttgagggagtcccttgagaggccagggcacacagtttccagggctggggccattgttcacagacagagccttaaagcaatgattcccaaagtttgtggcttgctagaatcacccggaaatctttttaaataaaatcctgatgcccagattcacctatattgttaaatgagaatgcccgagggccggagccagagtcggtaatctgggaatctctgctttgagtgtgcaaggcagagcttcaggcctcagagtggaaccaccgcacgcttccaagagacagatggtgtgaacctatggattaaatagaaaaaaagatgtacagttttctgttttacagtcttgttttggttgtgcctgccctactagtcctgacagttttatctccaaagaatagtgacctggcatctgtctgcagggacacaacacaaaaggccctgtaacttgtacaacaaatgctccagataactggagacacccaggaacggaagtcaccatgaggctccactgcatttgactcttcctcctgatttcctgcatggagggtcaggctcagagctggtcacgcagccactcttgaggttacaaactacaaagcagacatttgcagccagcacatacatgtcagttcaggaagagatggacacggaattggggagacatgtaccgtggctactcctgtgtgtgttgctatctctgaaccttgttcctcccctcctctttgaagggaccctacttcagggacttccccagcacccagagtcctgaattttcaacagccttcccatggccccacagatggggatgtcctgctgcctgtccctctcctgccggggccactgtcctcccactgattcctctgtagggtaggaaagcctcctgcagcccccagcggcctgtggtcagtgattgctcccggcggccttgagcaccttgaggccctgaccgtccttgcccctggaattctcctgacccctgctcttctgccatggtgccgtggtctgggcctcccttttcaggctctgccatggtcctgttatggtttcagttttccctgctgctctcagtcacgggctgagcttcggtccttttcctgtctcaggtccccatctccagccctgacctctctccagaccttctttctcccactcgtggtgtccctgttcctcagcccctcccaatgggcctctggttcctatactcctgtctccctgatggcttcttcgaatcatgctggtcccttatcaatagcttctctaccgcactccctccccaggcctgtggctgccaccctcgtggaagcagactctgttcctccacccaggacccaaccctgccagcccattgcctggggatctgctcacccagctgccttccagatgtgccctcactcctccctgcaaacacagagcctggccggccgctgccgccaccctgggcctccctcatgctgtccctttctcttggtcatccacagcttttccttcctgtatgcgatttgtctttatataagaacaagaagtaagatttttctgggagcttctgttcccaatgtctttttcctcatgctgagctcttgtgtgccatgtgggctgttgcttctcatgtgctcgcctgtccctgctgcatggtcagcccgtgggggatgacggctgtcatctccgactccacagtgtcatctctagggccctgcctgtgtggggaaggtttgtagcacctgcccatttgcaggtggattttatatcatgggtggagttgtaagtttatacggcaagataattggctagggactggtgaactgtcatttctgttgagcaggaaaacctgagaggcagtagttcttctcctgaagctatggcccaagaaagaccttttgtaattggaaacttaatataaaatgatagtttgcatcaggtggcatagcatcttttttttttttttttctttgagacagggtctcattctgtggcctgggctggagtgcagtggcgtgatcatggctcactgcctcacaggttcaagtaatcctcccaagtagctgagactacaggtgcacgccaccatgcctggctaatttttgtagagatggggtcttgctgtgttgcccaggctgatcttgaactcctgggctcaagcaatttgcctgcctcggtctcccaaagtgctgaggttacaggtatgagccactgctcccagcctcctagcatcctgatgaagagcttgttctttactaaatcttgctgatcccccctcccctgatttgtaggagggcaatgatttgtctgctgcatcgagttgtgcacattaaatgaattcataaaacactgatgtgttagcacaattccttttcaatacatggcatcttaatttttgttcacccattgtaaaggatgcctcacacagttgtagtaatgggaacaagagcatttctgacccttggcctgagaaactagaagtgaaactgacttagagcatttcagtagcccagaaaacacaatgagcacctaccatgcagggattatagtggaccctggggttccagggatgaataagacactctatcccaaaagaactcatcaaggtaaagaagaagttgtcgacaagttagcgaaagtgaagaaaagggaaaatcttagggggaggagaggggaactttattttaatggaaggagactttcttcaaactgcttttccaagacaggagaaaaatcccatggaatttaagtgcctccaggagtgtagacagcaagttaccagcctgcgaggggtctgctcagtggtcaggacaccgtgctcgtgagacagagtgggttctacccaggttattcctctctgttccatggccacaaaccatgtcggcccttgaccctgattcagccccggccctggctccttggacagcctaggcagccatcgcccagcatcatcttggtgctggtcccactgatggagcaagagcaccacctttccattgctggaggcctcctgaagaatccaagaactacagatattgggaagatactaagtggactcacagaaagtaaacatcacaggccaggcacagtgattcacgcctgtaatccctttgggagcactttgggaggccaagacagtgagacaggattatttgagctcaagagttcaaaaccagcctaggtaacataaggagatctatctctacaaagaaaactgtattttaagtttttaatttaagaattattttaaaaataaacatcacatttacactgtcacctctgtataatcagccaaatccagttttcatatttaaagcgaatgagccccctcctctcagtgggaaagatgagctgaagctttactccctcgatagtgttgggaaaagaaatcagacaaaaatctaaggaaggaccaaatattgtacagagtgtgccagtaggcttttgcaactggactgaaaatacctgccttttctctccacaggggaaagtggaagttgaagctgggaaagaaggtatgaagtttgaagcgagcgccttctcatactatggcgtgatggccctgacagcctctccaggtatgtttggttcccagccgcatagggcaggaccacgtgttaggaagtaaggcccctctcctttcatcttgctttctgtatctgccagctgaccccattcacttcctttttgaactttttttttgaagtatatcatatatgcagaaaatctgcacaaatcctaagtatatacctccatgaattctcacaaactgaacacgtgtaaagtggcacccagaccaagagacaggacgttaccagccccacagaactcccatcacgctcccttttagtcactggtcccccagagtaactgctttcttgacttctcagcctaattctgcctgcttttgaactttgcataaatggagacactgtgtgtgttacacagaggctggctcctttctctgtgtcgtgcttgtcacatcacctctgttgctgtgtgtgatcacactatttcctcttgccatgtctagtatgccactgtgtgaatacacagcagtgcacgtgtcctttcattgctgatagacattggggtagtcccgtctggggctactgtcaatatgtggctttgaacattcttatacatgtctttgggtgaacgtgtgtgtccatttctgctgggtgcgcacctgggactggcgctacgtgtcagagggtgtgcctctggattcagctctgatgtacctgcttactcccaacctgtgctgtgtgaattccggttgctctgcatccagcacttggtattgttgagtctgttaaatgttagcagtttgggaggtcttaatttgcatgtttctgaggacgaatgaggttgttgctatatactgactgcctgtggccggctcttgtctggagagctggccaggcgagtcagccagttaagggtgggtggccatgggggattgacagttctctgaacacaagattccaagatgccagccagccagatgtgctctcagacatgaacacagatagatacctggtggcttgctggcctctggggatggcgctgcttggcagagcgcacacgcttgctattaatacctgaggcagcccgaacaggtcgggcaggtcgacagagatgctggggtgccaccttgtggcaaaaacaccaaatgatgtgcggttttaggaaacttcatttacaaacctcaaacctaaaaataacccattttaaaagaattcctgaaagccaggcttccaaggggaggagatgcctccagacaagactgtttctgtgacattggtcttcatcgactgctccacccagtagtctgaggaacccaaagatgtttcagttagaaagtcactgagacgtcaagaattctgtcgtatttctaaacttcctctgccccaaatgccccttctcactatccttgtgcaggtgtttgagtcctggaggcacagtgtccccactgtcaactgctgaccaacacccaacacccactgtgaacatgggcctgtctgaccctacttaatgagtaggtttctgttgtaaacttgaaggtgaccttcgttttcactgcttagtgagagagacagggtagctcttacctaggcatgagaagacctgggttatagcttcagttccatcacaggcaggtcgtgtggtgttgagcgaggcccttggtctcatccttgttaagaggatataatgatgccagctcatgtgattattagaagactaggatgcagtgatcctcacacaagtgcttcgtccccttgaaagcatgaggggaaatgtgagtatagtagaaaggtgcctgactgtgatgagttttggcagctgacctcaaattagccccaggtgagcagaaccagatttataagatggctttgaaaataaactaggagtgggttgtacatttctaccaattactggttcctgaaacataaataccagcgcagttcctgttgaactgtaatggaaggacaagtctcatttagaagaggatgtggtgagcagccctctgagtctggaactgctaaaaaggaaggggaaatcacttgaggtcaggagttcaagaccagcctggccaacatggtgaaaccccatctctactaaaaatacaaaaattagccaggcatggtggcacatgcctgtagtcctagctacttgggaggctgaggcaggagaatcgcttgaacctgggaggtggaggttgcagtgagcgcagagcacgccactgtactccagcccaggtgacagagcgagaatccatctgaaactaaaaaagcggggggggaatttcattaatggcatcttacctattccaaagcctagtattttacttaactttacaactaagatttgggattttgtatattcattgagaggcacagttagtacagatatcacaaggtaaagtttctgtttattgatgttcgctgtctggggaaaaccgacaataatcagttcttaagacctacctgccccagaggtgtgattcctgctcaacatttcatgttctgagacttttcaatctgatggggcagtgagtaagtggtgatgaggatgactctggtctgcattcccaggaaatctgtgtatgcgttctttacttactttcctctatgttgagatttgaaagcgttcctaacaattcaaagcttcaggtcaaaattaaaatgagctaaagttgcacagatggggagctgtaggctgtgcagtgagtgagtattggggtgcaggcgccagcggtttgagtcaggctcttagggcagttgactaatcgagctccccttttgcgcagctactggtgatttaagcccttaagagtagcaggtttcgagctatcaaccccaattggttattagtggcttaagagatttcttggttagtaacaaactcgtgggtaggatttctcctgatcttggcctccctgtattcctcttcctggaaagcagtgtgtgttgttttgtttctataataccataccgacttgcatttctgcaactgaatgctcatattgtattgatagaacaagtatcccctcctgtcccttgattacagagatctctgttcttgccttttgatgcgatctcaccctgtttttctccatttttcagttcctttgtccctgtctcgtacctttgttgtcagcagaacagagttgttagcagcaggttctccaggtaattctgcatgcttcctttccgtaattctcctgattgccttccttgccccccatcacgcctggctggctgggtctgctccctttacctggacaggctgttttcagtgttccttggagcgctaaagctctaaggttccgtaactttatagcgagctctccaggaaagcataagccacagcaggtggagagtccagaacagcgcaaagtcaccatgcacaggagtagccatgaagcatggaaagggagggcggctctggtgtggattgttagcgctccctgcccttgtggctgaccttgaattttcaggtcagcagtaggggactgttcttggttcttattctgacctcagcaagtcatggtatctggagtttgcagaggccctgagggcctcaaaccctgaggccgcttttatagagcacatttgccaaaggcctgagagctgtgaactcttcttggtaagcaagaaaaataccccatccacacaggcgcacgacattcttgtatcctgggttcttcccacatccgtgtgagtggagcgcgagcgcctctgctgtccgccaggcaggcggccctacttctccccaccaccaggcaggcgaccccgcttctccccaccaccaggcaggcgaccccgcttctccccgccaccaggcaggcgaccccgcttctccccgccaccaggcaggcgaccccgcttctccctgccacctgactttgttttggagtgaacacccggcacattcctatcccgctgctgccgactgccctgcaggagagggtggccagtcctaactaatacgtccagctattaaaaagaagggaaaaggcttaatctgtctttaattaaaattgctgggatttcctagttggtaacacaattttcctatatttatcttcggagttttttccataattactatcataaaactttggaacataaacttggccacaaaacctgacctgaactgggggtcagccactacggttttagctctacttgttgtgaatccttgtccgtctcaccaaaagttaatgtgtttgcggactagggccgccccagaattgctggtggtgtatgtaacatggggtgtatggactgtatcaccttccagaattcaaacatctctctggcccccaagggcttcagatgaagaatgtggacctttattattattaatattttaagtaagatggcacttgaggctctgagcagtgggctcaagctcagggttgcagcgcctctgctcgcgctggcgcccgtcgagctgttgaaagggacatggaaggcagggcctgctcctccagagggtggccatggggccaggcatcaggctcttggcagaggagagggtccactcacacaaacagagggcagtggggcgagaggaagcagactgagtctagatgctttggaagatcagagaaatccccctaaaatccttctcaggagaaaacaggagactcagaattactgcaggaggcctcagacaagcaaagtaccttgaaatgttttgtttttatagccttcaaatgttaacacacaaacactgtttcaaaagtatctagaaatggtgatgagattggtggccaaagcgcagggatacagtaagatctcgtttcaaaaaaaggactaatctgtcaccctgggtgaagtcactgcatgtgcaaaaccttggtcatggggtgggcgcatggtggcaaggtccgggaggaagctgacaagaaagaatagaaaatgggccgggcgcggtggctcacgcctgtaatcccagcactttcggaggccgaggcgggtggatcatgaggtcaggagatcgagaccatcctggctaacaaggtgaaaccccgtctctactaaaaatacaaaaaaattagccgggcgctgtggtgggcgcctgtagtcccagctactcgggaggctgaggcaggagaatggcgtgaacccgggaagcggaacttgcagtgagccgagattccgccactgcagtccgcagtctggcctgggcgacagagcgagactccgtctcaaaaaaaaaaaaaaaaaaaaaaaaaagaatagaaaatgccagctgggctcacttatggggtacctactgttgtcagataagcactttgtacgtgatcttatttttaatccttgtcagaccttataagatgggtaccagggctgggtgcagcactcacacctgtaatcccagcactttgggaggccaaggcaggtggatcacctgaggtcaggagttcaagaccagcttagtcaacacggtgaaaccccgtctctactaaaaatacaaaaattagctgggcgtggtggtgcatgcctataatcccagctactcaggaggctgaggcaagagaattgcttgaacctgggaggtggaggttgcagtgggccaagatcgcaccactgcattccagcctgggtgacgagagggagactgtctcaaaacaaaacaaaacaaaagggtacccggtaccatcatccacattttacagataaagaatctgaaacttagcaaaattgggtcacctattcaaagatccattctgctaaatataagtctgataaattgttaatttgccttgttctcgtagaaatggaaacaaggggaactgccactctgaatttaatttgtctaacaatggaaaattagttcatgacttgacaattggagggagagttaagatacaaaaattttaggagaaagtggccaggcacggtggctcacgcctgtaatcccagcactttgggaggctgaggcgacaagatcacttgagctcaggagttcaagaccaggctgggcaacatggcaaaaaccccatctataccaaaaatacaaaacttagctgggcatggtggcacatgcctatagtcccagctactcaggaggctgaggtaggaggatcccctgagcccaggaggttgaagctacagtgagccaagatcacactactgcattccagcctgggtgataaagcaagaccctgtctcaaaaagaaaaaaatattaggagaaagtgaactcatcactggagattcttggagtacttatgttttgttccgggtgtcctgttttaagacggtgatggggtgagatgaacagctgcaagatttatcctagagaagagacttaaggagaccatcactctcttcacctatctaagggctattttgaatagcagagaaagaaaaggtactaaagctccacacagaggaagtgaggctgtcatctgaagttagggaggcacatttggatgggcacaatgacaaactttcccgatagccgaagggcaggtgcagccaagggccagctcctccgagggcagctgtcagggacacattgcaaagaggagccaagcgtcagatgggagaaatggtcccctccaatcctgtgatacgatgcaattcaagacctggccagggtgggcacacagttcctatctgcagtagttggttagaaaagcaaaaagtgaaagaagccttgatgagggggcattttttaatgacgtttccattagaagccacagtgaacttccatttaagagcaacaacacccagactggcgctccttccactttgttttaagggaaggatgccacaaaacctcactgaagactctagcacccaagataacttactcaaactcgttagggatttggtgtcttctagctttcttgaattcctgagacatcctcgggctacctgatgggggattttactggggtcagagacgaagataataggttcagctagagggtatggtatgagcagatgagtattttgatccctttataatacatactgatttattaatattctcaagagtcccttgtttttacttcgggcaaagtaatgaagtgctgtcctctgcgtagcctacctttgatatcaagcagcttctgcatgttgggccttggcccaacctcgcctgagcatctcacagtacccgggaatgttcctcacgaaggcacacagtgcagggtttttgctgttagagacttgggaggattgtgtctgtcacatacacagggccaagcagctgagatggacatagcctgctggtacagggaagcccgcgagtccgccatacataggataccctctggcatactgtgcggccgagacatctggaatcagttggctgggcttgtgtggcatttagtattttttattttggaaaataactggttttattggctgtatctacttcacttaaacagttggatttttccctccttttccaggtgaaaataagtcccctcctcgcccatgtggcttgaatcactcagactctctcagtcgaagcgaccggattgacgccgtcacaccaacactggggagcagcaataaccagctcaattcttcgctcctccaagtctacatccccgattactcggtgcgagccctttcggatctgcagtttgttaaggtgagagacgtgagtgcagtgtggctggacctggcagttagttgtcaacttccctggcaaattgtctgttttgctccttgccctcctcagaactctccctttgtcactttgtgggtgccctgccttccattctcaactacacaccctgtcttcgtctgctgtgcccaagcctcaggttgagaaaaacgttgatcttcttggttctatccaatgagctgccaaatcaaatgtggctctttcagggaatgggagccagagatcctggaaaaaagagtagccccttttcaaagagctcctgggtgcgtggctccctgcctggccctgggaaggctgaggtcaggagacttggagggttgcggggaaggctccacctctgtcttctgccgggcagtcagagtactcatcttggtctgaaataaagatgacttttggagaacaagccagctttagctgggagaaaccagtctctattttctagtccctaaaattttgagacaatatttggaagtgggttacatcagtaagaactgacttgttcaccaaagtcaacttgaacttgacaaagtggctcactgcgctcaagtgtgattttctcctagagaggctgctgtgggcctgtcgggattgaacgtgtggagatcagagaacctaaaaataagcattatcttggtttgttttctgtgccatcttctggccccagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctcctcccctgtccctgggcccatggggcccggcagtggctgtgtcccctgcctgagggctctgtgcctcctgcctcagatgcggcctgtgccagagaggctgcctgtacagccagggtcagtttggccccaaacagggattcagaaaccaaatgtgtgttgtggccattttatgtgtgtctccgtcttattttaataccaaattcatcatgtagtgaaattatgtcaggaggtatatgagtgactgaattcttaa

SEQ ID NO: 116 - DNA, 160270 bp, Homo sapiens; identical to SEQ ID NO: 115

SEQ ID NO: 117 - DNA, 124968 bp, Homo sapiens
gtgcgtgtgtgtaaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatattgtaagtatgctcagtatctaattttgtataccttagtattttgtggaataaccacaagcacaaatgtttactccttatatttatgcttttaagataaaatgcacttgctgataaaattgtaatctcacttcagaattgttcttcttagtatatgtctggtatttgtattaaagaccataatatcttatcatagtcaatagtgaagcgagactgatgtgccgtgtaaacctaggcttcataataaccaattcatataattgatattttaagcaacattataatatttaaagagtagtaattcttaaactgtattcaaggaatatattcattgaaaactcctaggaaagttctcacatttgtgccagtttctgtatagttgtaatgctctgtcgcccttattctttgtcatttgctatcataggtgtgcttctgggcagggagatgcattcataaaactctttttatttagcaaggtttatcactgttccttgaaagaaaaacaagggaaagcacaaagcaatgaaaaacataggcacaaaagaagctccaaatgggcatgttatttttactataatgacaaattttgttttctctgtgtgtgctatggtttatttttcagaaaatcttttttaaattcaagggaaacagttgttgtgtgttaagctccatttgaattatagtatgtagacagaaataaagtgtttttgtttcttaggtaataaatgatgaaaaagtcaaagccaaaccaagaacaaaactttctgggtatctttaatactttatgattccgggaatgtgggcttttactaatttagaaattaacaagcctttttatagtcctgtgtctcttaaaagtttgcataagttttgttaactctgagctcttctattaaggaatgtctcagggtaactttcaatcctgactctcccaattgtaatatgtcaaagtgattatatcttccttttcctccttctttcctccttccctctgctccatcgcatctaaagttaaaggacagcatcaaaaccacagaaactattcagaatcctggggaaatattctagtcctagccttctccatctctaatcttgattactgacagtcctattttttaactgaagggaaaacaataaattgcaaaccaccataaaaaatgtaatgtttctaattataattgcatgtttaaactaccagagcttttgacatttgtggccaacagcttcaaaaattaatgccatattttaccatccctattccatttcaatgaaatgaatagattaaataagccagaggaatatttccaaaatagtctttctagtatgaagaatttaagggtatataaaaggtgtttagggcaggttgggaagcaactttggccactgtgttaccagtcatttcaggttaggaaaaaaattccatgtttacctgtacccttttgttaataaattattttcatgagcagaaaataataatgatggtggtgatgatgatgccaaaaccctctgtctctttaaatttaacttctcttttgattcaaaagaaaatttgggagtgtagtgtaagttgagagctccaagttctcatccttccacgccttccccaggaaatgagggcataaacatttgcagcaaagtttggcaaggcaattcctcgctacatggtattaactgcatgttagggtgggggaacacttgtcagggacgccctgaaatagcacccacagccgtggctcaccttgagtttagcccctcacccaggccccacctaagtgagaatttcctgggcacatagcaatggaaatcaacagccacacataaggacaaattcttaaacctctgtaaatgccccatggttgttgtttctttgtgtgttttctttgttttgttttgtttttatatccactttcctgtaacgggaaaggcgatgtgatatcatggaagacacctaacctaagacgcttagctgcactaccatgtaccggttctgtggttttcagcaaatgatttacctcttctgagcatgtgaaatggcaatcaaatcctttaccctgtctacctttcagaaaccctgtgttccattctttattacaaaaattacttcctgaatcttcacaacaactctattatgtggatacaattaagcacacgaggtaggacattcagtgccttgtcacaagactccagctaataaatgccaagattggaatgctttcagagcccgtgctctctcccctagaccatgataattctcagtagccataatgtgtataaatgggctttgaaaactataaagcccgttacagacgtaagcaactattagtcatcctttcaaccaaaaatacctatgcatgccagagcagtgaccatgctttattcacctaccttgttaaagtaagcatggtccctgctctaaagggataggatggagaagacggcacgttgatctagaattcaattcaataagacaagtgcaaaaattgaggtccacacaaacagaggtgacattaagacttagaaaagatttccttttagccttgagaatttttcattctttaaaaatccttctgtccatagtctaattaattgtattgtgccaatgttaattttttagttttgtaatgtactaaatttatgtaagattaaggaaagctgggtgaaaggtgtatgggacctctctatactattttttcaacttcttgtaagtatatatttcaaaatccgtggttaaaaaacaatccccaggacaacttgtattataagttcttatcagaaaatgctgtattatttcttaaatgatatcactaagcaaaacaattcttttaatgttttagataggcaggaaacaagtgaagatataggaaatagaaggagttcaaacataagcttgatccactttagtattttgccaaggaccggcccagcttagtaaggtcttctctttcagactcctagagacacttaccaggctacctggcctttgctttggatcccagcactggcataacttgtaacagattttttctgtaactatgaagaagagaaaaggaagagacaattccagaacagaccattagcttggttagtacgtggaaaaagagaatgttcgcatatttatccaattccaaaagatgggagaataaacataccaatatgcagaccacagaggtatactgtgtcccaccttatactttggcgggggggggttgggttttttttttaatttgtataaatttatggggcatgagtgcaatttggtacatgcctagattgcatcgtggtcaagtcaggacttttagggtaacatgcgtggtaccaattaaataacttctcaccaccttatattgtggaggctgctgacaattttgtgttgtttttactacatattttgaatcatatttttaagtttcaaatggaaggaaaattaatgaatctgtgcaaatgcaccctgatctacataaagggaaattattatgtttatgaactaaatagtctttcaagtacaatttcacacattagtacaaacttgttaaactaaaatgcctggagttgagtattctagttaggtttaactttctgtctgaaaaactgtaagcatttagaccatttgatttcaatccttatatttatgggtgtagttgtttttctatttcccatttattgagaggtctccatggatgaggaacaatgtaagtgctttacaaacatgatcttattttattcctataataaccctatgagatattcttgctttacaaaataggaaacagagaatgagaaatatttggtagcattcctggcaccacttcttagtaatgttacaaaggagatttgaatccaagtctatctccttaaaaagcctatgctattaaacatgattcaattctaacactttcttaaattataatatagaatttaaagtgaccttaacagacccctgacctagctcactggccttcaagcaagttagatctttctctattttagatattaatccataaagaaatattagccagcccaaggtctcagagctggtaaatccagggcttccaccacctacggtgagggcctccccatccaaggcaagtttaacaaatccatgctaggcgtttatatatctcctctaatgagctggtgctatctgctttgtatacattcctcagtgtacaccaacaactgatgaattagtatatgtaaataatttgaatatatagaaagcacttttgtttgcagcacatgaaacttagctatacatacagcaagtgccaataaatattgacttaattcctacattagtttacctctccctcctcctggatattttattagccccacaaccccaacagctctatttcctgcctatgtgtagtgatcccatactctttcatctttttaaattctacagcttcatctatttctgtgatcagagcaacaaggacccaacactaaaccaaaagctctttccttctttggagataagcaggggcaagttgtgaatatttcaaatttaggttttgttctctatcacaacaaaaataaatgtcaaatggaaaaaggacagtgtaaagtgagatatcatgttgttcatgttagaacttggtattttcctactaaataactgtattttatagcaacctggatattattagatttgttgttaaatagattcattttataattatttcaatactacctaaattaactgggtctccttatttcttcaatattttatgataatgaatatgccttttggaaatcaatgttttcaaaaaatttctgagagttaatctttgggaacggtactcttgggacttttcaccagctggtctaggccacctggagcccttgcctctggccattgtgccagcaactctctccacctctctctccccatcattcttcctcaactcctcctcccatgttgctccaggaactcaagttctcattgagttcctatgcagatggacacagctctgtctccttagctcctgtttccaaatgcagtcctaggtctacatttagacagggtgctcagttgaaccaaaatgttacccacatgattagctacaaatgaaacagcagataatctgatacattctttaatagtaagattcacacttaaaaaaacaaaaagctgttgagattttaaataatttttttgttagaggattgagtatccacttgaactaagaggccatataattatatgagttattccattgattaaaacatatagttggccaggcatggtggctcacgcctgtaatcccagcactttgggaggccgaggcaggaggatcatttgaggtcaggagttcaagaccagcctggccaacatggcgaaaccccgtctctactaaaaatacagaagttagccgggcgtggtggtgggcgtctgtaatcccagctactcaggtggctgaggctggagaatcgcttgaacccaggaggcaaaggttgcaatcagccaagatcatgccactgcactccagactaggtgacaagagtgagactccatctcccccgctccaaaaaaaaaaaaatatatatatatatgtatatatatactgttgcctcctactaatcttttcccttggttctcatctaattcatttaaggaaaaatgaagtttctttttccacttcccacagtctgatcctcaagtaaattgctattacttagacagtttctacttaatgttgctcaagtactatttttaatttcagtttcataaaatcagacttttttgagttggaaggcaaggtaaagctataaaggacaacatcctcatttttcacatagaaagaaactaaggccatatagctgtgttccctttagttttcagctgtcttattcttaactcacttttaaaagtgggtctccaaatttcatatgtaggacaaaaagggcaagaaatatcaaaagggtaaaatatcacttgaaaatagaaagaacctagacagaaattgttaaaataaatttattatctaccaaaatcctagcatcaatgattaagactttgccaatacactaagctagtataatccctcttcacatacctaccttgtggaaaaacatttaaatcattctcacaaccaaggagagaaaggttctcattgcacctgtacatcaccatgtttgcagccaggcccagaggaattttaatgaaagggactttaaaaacgcttagagtaaggcggggggcagtgtctcatgcctataatcccagcactttgggaaaccaaggcaggtggattgcttgagcctaggagttcaagaccagcctgggggggcaacatggcgcgaccccccatctctacaaaaaatacaaaatttagccagtcgtggtggcaagtatctgtagttccagctactcgggaagctgaggtgggaggatcgcttgagcctgggaggcagagattgcagtgagccaagatggtgcactgcactccagcctaggcaacagagcaagaccctgtgtcagaaaaagaaaaaaaaagctcagagtaagtcaacaccaagtggatgtcttcactattaatatctcctctccagtccatgctcctatcctattccccagacaatagagtcatctctaaagatgcagcccttttcatcacatgccatgcaaatcatgaatctggcccttggggtcacccctctaaggtgagagaggcttcatgtgccacaggttgaaaaatgagacagcattgctacagcagaagaaactttgccaacttctcaggagtaatttatagactatcagaatctctcagacacttctagtgtccagagaaatcctctcttttttctgggtgccccagataatgtaggcaccaaatacctgtgtgcttcaccgctcctataacctcttctttcccaccaaaaaagaatgccatctgttctgtctttctgcctatgcaggtgccagagagggcggacagtggaggccctggtcgtagggagtcgaatatccctaaccttactgttttcttccctctccccaccccagcacacacagtttcctgagatagagtaacatgtttcaatcctcacctttgtggggattgaaaggacactcacagagcaacacagagcatcctcactgttatgttaaacgaccccaagatattcattcctgatatggtaaaacataaatcccacactggtcataaactctgctatcatgaaagtctgatctctttttttgcttgcttgttttttgttgttgttgttgttgttgttgttgtttatgagacagggttttgctctgtggcccaggctggagtgcagtggtgtgatcacagctcactgcagcctcaacctcctggactcaagtgatcctcccacctcagcctcctgagtagctggtaccacaggtgcatgccaccacgcccggctaatttttgtattttttgtagagatgggagtttcaccatgttgcccagactggtctcgaactcctgggctcaagccatccgcccacctcagcctctcaaatctctgggattacaggtgtgagccactgctcccaaactccttcaagttttgatcctgctacatgcttgggtttgtcctcctttgcttctttcccagattgtctatttagtgccaaatggactccctgcagctttccctttcctggctaagcaacctagatactggcttccagttctaattaagcagttcctctttctcccttagcgcttaatttctccttcctatcttaatgattctctgtattccttagtctcaccacaccttctgacaaaatacccacaaagagaaactctcctgtcttggtcccaaatcttgcaaccctaattctgatttctactcatttcatttccctaataaatacttcctcctcattaattaggactttcatagagaacagctgcctgttaaacatactacttgcagattacacccctccctcattttgcagttacctgggttcatggacatttttggccgatttttttcagtgttgtgtaaattagttccaacacctgatcctcataatacaagcaagttatgaccctgcagtttcctgtagttgcagccatttaaacagataaattttactttacagagtttaaattaaaacattataaaatagaacatgcaaatagataggaaatgacaaattttgaacaaaatttatatgcgtgtgtgcctggacctagtgaaagaaatcagataagctgccctaggaagcttttttggaagcttttatccaggcacatattgcaagtgtaagttaatgaaaataactcttctcaggtgcatcacgcattggcttctgagatacagcacaatccactctaccattaccttcactcataaaacctcagattctttttatcctcttctctcaccctctgttgctcaccctagccttttgatattttaatggttttttcccagagcaggctagaaatgtttgattcattttcaatggtccagaagatttgccgtttttactttctcagttgtggctgatttgctggaaattgcagaactgcctcatggtttataaatgtttctactttctcacacatttcaaacttagacagagtgacatcatcagtcatgctttctgttagcttcttaacctccatttaacctcccttttttgtgttaagatcaagagaggtggccagtttagcaaagtcaaatttagatttttatttctgcccttctaattgcagtcgttacccctgatcctgtgaacttgcagcacaacagtttaagttccctggaaaggaaagagggattgtttttctttgttgatattttctcaaccactgagcattcgtcttcagtggtgatccaaaataatgtggcaagtcatttgtctatcaaatccattttaatggaaaaaatctgtacaaagctttttgtagcgcatctggctcttgggcaccttttttcaaagtttctatgctagtaaacgttagcaggttcaatttgaaagctccacgccctcttctgttcttcaatcccctagaggctttgagtcttttttgagacagggtcttgctctcctggcccaggcttgagtgcagtgatgcaatcttggctcactgcaaactctgccccctggctcaagcaatcctcccaactaagcctcgcgagttgctgggactccaagtgcatgccaccatgcctacctatttaaaaaaaaatttatagagaggagaacacactacattgcccaggctggtcctaaacgcctgggctcaagccatctgcctacctcagcctcctgaagtactgggattgagccactgcacctggtctgcctttgactcttcactgtttctctctctttgatccaaggcccttggcctcactctctgcccctctgtttcctccaatcactcagcccctcactcctgatcctctcctgacacacatattcccctactgcacagggtcatcttgaacacaaaatttacttctattctaattttttcaggagaatccacccttcggtttttgtcctttttttcctcagaaagcacagggttgtggagggcttcagggaatgttgacaaaggtaatgccagcattctctgacatgaagtttgagggtggaaggaaatgttataaactactactacacacacacactttaaatcttatgccatcattaacattaagcataccaaatccaggtacgatatatagtgtaaacattttcatgtttacagaccagaaacctcatatgtgtaaaaattatattttatatttctatgactaaaattcagagctcatgactcctacataaaataatacaacatttaaatttgctaattcaaagtagcttggttttaaaatgaggcactttttctttaaaatgcaatctgggttttctgttggtttgggtattttgtttgtttgtttgtttgtttgtttgttttacatttagggggtatatgtgcaggtttgttacatgggtatatcgtgtgatgctgaggcttaggcttctaatgatcccgtcacccaagtaatgaacatactgcctgataggcagtttttcagaattttccccccctcctccccttttggaatccccagtgtctcttgtccccatccttttgtgcgtgtttacccatgcacccagtgttcagctcccacttataagtgagaacatgtagcgtttgtttttctgtctctgagtgaatttacttaggataatcgcctccagctgcatccctgttgctgcaaaggacaggatttcatttttttatggctgggtagtattccatggtaccatattttctttatcttatctaccattggtgggcatctagatggattccatgtctttgctattgtgaatagtgctgtgataaacatatatatgagtggaggtgtctttttggtagaactgtgtataaaatacaatctcaatcacttaagaaatcttacctgcgctacccttttccccttctccccttctgaccaacagcatgtgatttcggtgacagttttgcaaacatcaaaattgaggaggcaggtagagaggtgaacatctccagtcactttgccagctactcatgagggttaactcactctggcacggatgagtgacaccagcacccaccaaagcattcaaccacttttccacattgtcctccagctaatccacacacttctcaccaaagaccaccaccaccgtctgctcatagccttctcaggagagcacaggaagccctcaagtgtccttcctcacctattgggaactcaggcagattcggggctgacaaaggccctgtgtctagctcacccattcaccatcgcctccctcacttcaagaccctgcttctcctagagatgtgccctttctttgagctggacattaggatttgagacaagaatcacttctgcttaggcagtcccccaaattctcttagcagtttccaccttctcccttcccctacagagttttaataccaaagggacagggtgcttccttctcacatttcactctcagcaggttcaggaaaactgcttcgagggcatcacacatgcttaacccttaactctctagaggttgtggaaagactggatgttctgtgtccttcgttactggatcttaatgttcaagaccaatatggtagaatctaacaagtaaataaaaagaaagaaaaaatattatctctctcaagcacctgtcttttgccattgaaagccatgactctaaagctttggaatttaaagccaagaaggtgaggactcaggaaagtttttttgtgctctaccttccctgagcaataaagtacagtctaaatttctagttttagtggtggaagagtaaaaaaggaataaccatgaaggaagcataaatggacattaccctaaaatcagtaattataaacacaaagccacagtaattagaaataatcattataacgaaataccttagtaagagatgcactttttatttgcaaatcatatcatatcaaatttttagctatttcccaacactgtataatagacacaagtgaatatgcatatttacccttactctcaagaaacttctataggagaattggaattttcaaaacttgcctaatgatagatagggttagtctatcttcatttggtcgtttattttttaagtcacacacaaaaagtgtgcttatcctatttggattctaactcaaatatcttggctcaaaattctgtactctttctgataccaattttccctacttttctatttttctattctgttgcccacaatggttcctcatatttcacttacacctgcctttcatgtaacttttatttttaatctcttttccctacacttttctatatgctttttttcctattgctttaatcaacactaatcacaatattatagatgaaaacatcaatgtataaaaatattattcaaagcgtgaaaaatcccaaatcattaggcatatttattaaatttctcccacaaattctttctgatgcaatgtctaaaacaatagaatgtgtaataaataattggaaggagtaaggaatagtctcacatgacaatcttaccccctagaaactactcgatcacgttcttctctaattagtctcccagggacctacaccacttttaaatttattctggggaaattgtggcagatttttaatgtatattataatgtgctttattccatgtacttagatacacaaagtgttctagatcaatgttatgatattctgatttttttttttttttttttgagacagagtttcgctcttgttgcccaggctggagtgcaatggtgcaatctctgctcattgcaacctccacctcctgggttcaaatgattctgctgcctcagcctcccgagtaactgggattacaggcatgcaccaccacacccagctaattttgtatttttattagagacagggtttctccatgttggtcaggttggtctcgaactcctgacctcaggtgatccgcccgcctcggcctcccaaagtgctgggattacaggcatgagccaccgcgcccggccttattctgattattaataggaattatttacattgctaaagttataggtaagagtcattaaattgttgatgttttggttaaatgataagcactcataaatgttgtctgattatatcctcacatgaaccctgaaaggtaatgttttctcacctttccagaatgaagagagaaatttagaaatttgtcaatgtcacgggcacatcaatgcttagtccagaactcgaactcaagcttatctgattcccaagcctgagttttttcactcacatacaaacaccaaaatcatgtcctctctcatttttattattattattatatattattacctatattattacctataataagtaatttttattacatataataaaataatttatattgttatattaatatattacataaaaatattactattatagataatataaaattatttataattatataatattttatcatttattatatctcattttataaaacgagaattcctattcccattaacaggtgaacaagctagccaagcaagttgaactggttgcagatttaccctgttttatttcccagggagaggagagaagggcactgcaaggacaggtacagcatgcgcaaggtcatggagacaggaaaggacatggcaggctcagaacatgatgagaagtctggggtagtttaagaggagggctgaagcagatgcttggagatgaagttagagaggatcaccagaaccagatcatgaaggtctttgtaagccatgtgccagagttaggatggtaatatattagtaattcaaatcgaggttttgtacaaaatggaagtaacccaggcaaattaccaaaaatggactaaaatgtgagaaactgaaagcaatccttagagagggcgtggccattgcacttgagtcactggaaagatacaggctatgatcaagtcgaatcagctactggttttcacaaggaagtaactcaggcaaattaccaaaaatggactaaaatgtgagaaactgaaagcaatccttagagagggcatggccattgcacttgagtcactggaaagatacaggctatgaccaagtcaaattagagactggttttcacattgttttcctgggaccttaatacatttttaaaatattttctccctattcctatctataaaatacacaaaatatgtgtggaacacactacagaatgtttgttgaataccctgactgtgataggaccggcctttttgatattgcactccataaatatccaactattatctctatttctcattcttaagagtttgatctagtctgcgttgtgttttccacacttcctatttcccttgtgttattttccaactcactattttctttaactctggaaagccctctgatccagtttacaaataaggcaataaataaaacataacagaaaacattaacaaagtctcatactataatggacaatagatggacaaagtgcttatacacggttatttgaatcaaatggaatgaacccattatctggaagtacatacaatctgtactctttaatcaatcagtaactttgcaacacaaaggttgttactcagaaagtatcaatcaacagatttaagagattttattcagcaactataacctcacagcagtagaaaacagcacatagacaaataatttaaaatattgtgtttataggaccgaggcctaatacctgtaagaatataattttactctctctattttaatatatttacattttaatcaatagtactacccatgatatgtttaatgcatgggtgtaaattcattactttttctcatttgtattttcctttataaatgacaccttaagagtatgatgaaacagtgctgaaagtttaaggtgtattatgggaaatgcgtcaatcagagataacttcaatatccttagcagacttttaatttccctaagaattgcagaaccatagtcatgctatctagagaaatagcttgctcagaacatctttaaaataagaatacattcaatcattcttgcaggtaattattaacccaagtattgaactgtaagagatacctgacttaaaataggctctttttgcaaatactgtatacagtatgagcaaatcattgctaatgccttctaacatgactagaaatattataaatacaggtcatggaaaattatagttttaatacacatatgaaaagattagtggtttgccttcaactgaacaaagtcatattcttccactggataaattattttctggcataaattagatgcatatttggaaactcatattaactgtttcaaaataacatagccaggaaatcatatacactttggagttgcaatattgttgtactagatagcgtttacacttatgagctgaaagaattccatactcatggaatgcacaaagttttgtttactgtttccaaaaaaagtgacttctatgccaatttgtcaatttatattaggtttggtgcaaaagtaattgcggtttttgacaacgcaattacttttgcaccaacctaaaagaaacctagctaaactagaaaaataggtttgttcatttgattaacatagatatatgctctagaatctaaatctaaaatccaacctctctttaggatttttaccaatatttgatgacaaactacagctgtggggaatatagcattatccccaccactgtgtttactggtgagctagtcctcatttgaaatatttctcttcttatctctctttccttaactatctcttcctttcatcctttccttcccttgtccccccaaaaaacaactaaattttcttaatctagttgtttcacagacaaaatctgtagtccctagagtgtctatgaggtaggtaaagggcttatgtcctttgagaaaacagggtcttggtggaagactatgttaacatcaggcccgaagtgcccttgggggatagttacagaaattgggtcttacctagctgacaacagagtctggagaaaagaactacttcctgtatgcattaaagagaacttcacgacaccattatcttaaaatactcttctaagtatttcggacacacagacaattattcattcttcctttccttcaactaattttgttttacttcctacaatatgccaagcaccaatacaggcatcagaaataaatgatggacaactccagaaagatccctcacctatgggaatttataatctggtggtgatatttaaataacaaaaagtaaactaataaacaagctatctcaaagagtagtaagtattgtgaagaaggaaaatgtagtggaataggatagtaactagcaaggaatttaaagggatagagggatagatagagggatcccaagcaatcttcctgagggagggatacttatgctgaggcttgaagaatgaggaacagccaggcttgtaatgatctgaggaaagaacaatgcaggcactcagataggtggaacagccaactcaagactctaaagtcagaccaaacctagcacatcaagagagaacagtgtttgtaggtcaaattaagtgagggaagaaatgtggaaagaaaccaagttggtgaataggtttggcccatttatgtaaggtaaaaggtaaaggttaaaagtttggattttattccaagaacaatggcatgtcagtagaagttttagaagaggacacattaatgatctactttaattttgaaagatccctctggctgctgtgtggagaacaggatgaaaagaggcaggcgtggaagcaggaagtccaagtgagagacagctgcaattagacacgatggctcgcactctggggaaagaagcagagatgagaagttgactcatttcagatagtcaagtgctgaaggattgcaagtgggaggtgatgggctgagaaaagaattctttattcctaaaagatgagagaatgcaaaatgaattgtgagtcagagagaagccaaaggcattttttttgtggggagaaagaataggggccaggcacagtggctcacgcctgtaatcccaacactttaggaagccaaggcgggcagatcacctgaggtcaagagttcgagaccagcctgaccaacatggagaaaccccatttctgctaaaaatacaaaattagctgggcgtcctggcacatgcctgtaatcccagctactggggaggctgaggcacttgaactcgggaggcggaggttgcagtgagctgagatcgcgccattgcactccagcctgggcaacaagagtgaaatgccgtctcaaaaaaaaaaaaaaaaaagaataggtacaaaaatggtcatataatctatgacttctctatgaaataattcaattctaaaagaagggtgcttccttacacgttccacagatgtgcatccaacccatgtattgttctaatgagatgagtacagataggcaggtgagcaagggccattcaaaacacgcccaggtggcaacagcaataagagagtatgatggaagagggacaaaatgagtccttcctcactacttaacccagtgacctgaattagcaaccacctcccatcatgggaagcattacactgagatggcatcgtggacagaaagaggaagttaggcagtggcaacagaaactacttgctctgttcattaaaagataaactggaatgaagctggaaaccatcattctcagcaaactatcgcaaggacaaaaaaccaaacaccacgtgttctcactcataggtgggaattgaacaatgagaacacatggacacaggaaggggaacatcacacaccggggactattgtggagtggggggagggggaagggatagcattaggagatatacctaatgttaaatgacgagttaatgggtgcagcacaccacatggcacacttatacatatgtaacaaacctgcatgttgtgcacatgtaccctaaaacttaaagtataataataataaaatttaaaaaaaaaagacaaactggaaaggtttggagatgagggtgctccacaaaagatgaagagtattaactagttcctggtagacatttataataaaagaaaaaaggcatatgtaatacctgcttgatatcagagaaggtcttagcatcaaattagaccacatgtgctgcttagcatttcagatagtgtttggcccatggtgcttacaatttcatggattgatgattgattggatggtgtggaatctaggaagtatatttttagtacagtcattagttacaatagagctaaccgtgtccagtaaaaccttgtctcagactctaacagcctctaaatgcctttgaaattgtccttttggctaaagatggaaaaaaaatcacagatttcaagtcataaacacacaggtggagtggaatgaagtatctggaaataccttaacctggaagttaagagcagtgggtttagaaaaaagggaaattgtcatctaatactgagacttctgtgaaaggtaacaatgaggagattttgtacatccattaattttatctgctcataccaaacaacctggcagggggtagttactgttagcagaaaggggtcccgatctagaccccaatatagggttcttgcatctcacgcaagaaagaatttggggcaagtccataaagtgaaagcaagtttattaagaaagcaaaggaagaaagaatggctactccgtaggcagagcagcggcatgggctgctcagcagcttatacttatttcttgattctatgctagacaaagggtggattactcatgagttttctgggaaaggggcaggcaattcccaaaactgaagttcttccccttttgggaccatatagggtaactgacattgccatggcgcctgtaaactgtcatgcactggtgggaatatcttttagcaatctaatacattataattagcatataatgagcagtgagaagccagaggtcactcttgtcaccatcttggttttggaaggttttggctggcttctgtaccgcaacctgttttatcagcaaggtctttatgacctgtatcttgtaccaacctcctatctcatcctgtgactaagaatgcctaacctcctgggaatgcagcctactagatctccaccttattttaccaaccccaatgcctctgacattactaattctcatgttccagaagaagaaactgaagttcaagaaagctgtacaaagcccacagcgcacatctgggaatgtctaagaatgaccctccctgccccgcagcagccacaccttagcctgtgctgtaaacatgccgtacaggtgtggggagcacacactacggatggctgttgtctgacattgtggcaattccaaaaaaaggcaaaagcaggaaaacacactattcaactttaaataagcctctttgattttgctgaataataagtagttgtatggaaatgcattaaaattaaacttaccggcaagtagatgtcattaacaatataatagccaccatggcaatcctaaaaaaaagaagcagtggccacttttctgtagtctgtagacagcagtcagccaacagtcactgccctgggctgcccttgatggcattcagagtcatgctttttgttattttcccacaaaaggttagatccccgctatgcatcatgtccagaaaaaccttgtcaaactctcaaagtctctaaatgcctttgaaattgtccttttggttaaagatggaagaaaaaatcacagattccaagttataaatacacaggagaagtggaattaaaatctcataaataatattactggcaattaaaattctttgtgacttatacccagaattctcagagagcttcatgcacacacacacacacacacacacacacacacagtgtccagggtaatttcatatttactcaaaaactgtatgagtatatgcccaaattctaggtagagggggagtcatatattctaaaaatagtggaaattttaaaacttggaaactatttcagctccaagtttaaaatataaaaatatttcctaaacttattttttaaaaacactttattttgaaaaatttcaaacatacacaaaaattacaaaagtagtataatcatacccatacacctttcacctggattcactcatagttaacacttttccccatttactttatctccttcaccaaacatacatatatattttttcttgctgaatcatttgagactcactgacgacattatgacccttcgcaagcacttgagcatgtatctccaaagagttacagtctcttagcccccatacaattactaaatacaattaacattgaaaaatcatattatttaacatgaagtctatatttatatttcagcaatcgtctcaattacatcctttatgcggggtggccgggaggaatgatgcttttcttttttgtttttgtttttttgagatggaatctcactctgtcgcccaggctggagtgcagtggtgcgagctcagctcaccgcaacctccacctcctgggttcaagcgattcttctgcctcagcctcccgagtagctgggactacaggcaggcgccaccatggctatatatatatatatatatatatatatatattttttttttagtagagacagggtttcaccacattgaccaggctggtctcgaactcctgacctcgtgatttgcctgcctcggcctcccaaagtgctgggattacaggcatgaatcactgcgcctggcccagaatgatgcttttctaatccaggctccaatccaggatcacacattgcattcagcggccgcagctgtataatcttttatcaggaaacaatgacattgtgagatttgaagaatatggacaagttgttccatagaatattcttcaattcaggtgtgtctgatgcaagcatacttgtatatacctacagtaggccttttgcaaacccaagactgttacaaaacttaccataaaaatacagcaaggaaagaaagctacatgttatgttcagggactggtctcctgttaaagtgcctccttagatttgcatcaatttttctttaaaattatgactcacaggacttcctgcttttgtatctgccttgttcctctaattgttgtcagccagtcttcaaacaaaaacatcacatttatctatcctgactaactttccaagtcatttcgaaagccataaccctaaaccccacaccttgccttcaccttttggcaatcattgcagagttcctttacttaatttcagttcttttgctcctttccatagtagagagtctgtattgctattttcatcagttccttctgtatcagttagaaaggcatcataggtgcaacaaacagaaggaccaagcaacagtgacttaaacaaataagaacttaagaatctttttttcacataaagtccatatggacagtaagaggggaactacagacactggggcctacttgagggtggagggtgggaggagggagaggagcagaaaaaaataactattgggtattaggtttagtaactgggtaacaaaataatctgaaaacaaacccccatgacatgagtttacttatataataaacctgaacatgtacccctgaacctaaaataagtttaacacacacacacctgcacacactccagaagtaagtgcttgctggcattgcggcagctattcagccatgccctgaggctcctaggttcttcctacctttcctgttcctccattcttcaggcactggtttttatgttacattgactcctaatagatggaaagatggctactgtcactccagacatcaagttcatgttcaaagcaggaagaaggggaagagtgatgtaaagctggattttcctccagttaccaggaaagcaatggcttttccaaaaatttcccaagaagatttctagtttttaggtctcatggtcagaattgggtcacacagtcccacctcgctgccaaggaaacagggaaagccagaaacaggagtcaccttattgcttggggcagtcacctcatctaatggtgcagaacacagtgtctccacaaacaagatggggattgtgttaacagaggaaaatgggaaatagagaatcggtagcaaccaacagtttccctgagccctcccagtcagtatttatatttatttattccccacttctctattccatttcatatttcttctcagtttttcttcatttatcttctctccctagtacttcctcctgaagaatgaactttcaaacttttttattaacactccatctcccacctagaatcaaatagtattacaacagctggtactgcctcttccttcgacacagaagaaaacctaaaatccagtaagacagagtggcatgccaaatttgcccatcaatttattggcacattcaagaataaagcaaaactctactgaatatcgatatagtagtatctgcctctgaggattcttggtgcatatttttgcattctgccatgtttcgtccattttgcccctaccttgggcatttaaatataaagattcccatgagatcggatcaattcagctgtttatttctagaaatgtctataaagagaagaactaacaagagaaccatctttttatttttttaatttacttcctaaatataaatgaaggagaatctagaaccactgtcttcattggaaatcattgttccaaatgaaccgcaagtctgagtttataaagctgccatctccaatatgtctgttgagaaatatgtctatttacatacatcatgtttgtttctgaccttgtgggacaataacttggaatgccctgagcaacaaaaacataaaacactctgatgagacagcatctcatccttgcactgaaggatttcaaaagagggacagatcacccagaatggacatggtcatagaggaagtaagttagaagctataattgaccttcatctttttttttttaattttattttattattatactttaagttttagggtacatgtgcacaatgtgcaggtttgttacatatgtatacatgtgccatgttggtgtgctgcacccattaacttgtcatttacattaggtatataccctaatgctatccctccccctacccctaccccccaacagtccctggagtgtgatgttccccttcctgtgtccaagtgttcttattgttcaattcccacctatgagtgagaacatgaggtgtttggttttttgtccttgcaatagtttgctgagaatgatggtttccagtttcatccatgtccctaaaaaggacatgaactcttcattttttatggctgcatagtattccatggtgtatatgtgccacattttcttaatccaatctatcattgatggacatttgggttgattccaagtccttgctattgtgaatagtgccgcaataaacatacatgtgcatgtgtcttcatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttttttggctgcataaatgtcttcttttgagaagtgtctgttcatatccttcgcccactttttgatggggttgtttgtttttttcttgtaaatttgtttgacttcattgtagattctggatattagccctttgtcagataggtaggttgctaaaattttctcccattttgtaggttgtctgttcactctgatggtagtttcttttgctgtgcagaagctctttagtttaattatatcctgtttgtcaattttgtcttttgttgccattgtttttggtgttttagacatgaagtccttgcccatgcctatgtcctgaatggtattgcctaggttttcttctagggcttttatggttttaggtctaacatgtaagtctttaattcatcttgaattaatttttgtatagggtgtaaggaagggatccagtttcagctttctacatatggctagccagttttcccagcaccatttgttaaatagggaatcctttccccattgcttgtttttgtcaggtttgtcaaagatcagatggctgtagatatgcggcattatttctgagggctctgttctgttccattgatctatatctctgttttggtaccagtgccatgctgttttggttactgtagccttgtagtatagtttgaagtcaggtagcgtgatgcctccagctttgttcttttggcttaggattgacttggcaatgtgggctcttttttcgttccatatgaactttaaagtagttttttccaattctgtgaagaaagtcattggtagcttgatggggatgggattgaatctataaattaccttgggcagtatggccattttcacgatattgattcttcctatccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcattcatgatttggctctctgtttgtctgttattggtgtataagaatgcttgggattttcatacattgattttgtatcccgagacttttctgaagttgcttatcagcttaaagagattttgggctgagacaatggggttttctaggtatataatcatgtcatctgcaaacagggacaatttgacttcctcttttcctaattgaatgccctttatttccttctcctgcctaattgccctggccagaacttccaacactatgttgaataggaatggtgagagagggcatccctgtcttgtgccagttttcaaagggaatgcttccagtttttgtctattcagtatgatattggctgtgggtttgtcatagatagctcttattattttgagatacatcccatcgatacctaatttattgagagtttttagcatgaagggttgttgaattttgtcaaaggccttttctgcatctattgagataatcatggtttttgtctttggttctgtttatatgctggattacgtttattgatttccatatgttgaaccagccttgcatcccagggatgaagcccacttgatcatggtggataagctttttgatgtactgctggattcggtttgccagtattttattgaggatttttgcatcaatgttcatcaaggatgttggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcaaagtctgttattggtctatttagagattcaacttcttcctggtttagtcttgggggggtgtatgttttgaggaatttatccatttcttctagattttctagtttatttgtgtagaggtgtttgtagtattctctgatggtagtttgtatttctgtgggatcggtggtgatatgccctttatcattttttattgcatctatttgattcttctgtcttttcttctttattactcttgctagctgtctatcaattttgttgatcctttcaaaaaacgagctcctggattcattaaatttttgaagggttttttgtgtctctatttccttcagttctgctctgactttagttatttcttgcttcctgctagcttttgaatgtgttttctcttgcttttctagttattttaattgtgacgttagggtgtcaattttggatctttcctgctttctctggtgggcatttagtgctataaatttccctctacacactgctttgaatgcatcccagagattctggtatgttgtgtctttgttctcgttggtttcaaagaacatctttatttctgccttcatttcattatgtacccaatagtcattcaggagcaagttgttcagtttccatgtagttgagcagttttgagtgagtttcttagtcctgagttctagtttgatcgcactgtggtctgagagacagtttgttataatttctgttcttttacaattgctgaggagtgctttacttccaactatgtggtcaattttggaatagctgtggtgtggtgctgaaaaaaatgtatattctgttgatttggggtggaaagttctgtagatatctattaggtctgctgggtgcagagctgagttcaattcctgggtatccttgttaactttctgtctcgttgatctgtctaatgttgacagtggggtgttaaagtctcccattattattatgtgggagcctaagtctctttgtaggtcactaaggacttgctttatgaatctgggtgctcctgtattgggtgcacatatatttaggatagttagctcttattgttgaattgatccctttaccattatgtaatggccttctttgtctcttttgatctttgttggtttaaagtctgttttatcagagactaggattgcaacccctgcctttttttggtttccatttgcttggtagatcttcctccatccctttattgtgagcctatgtgtgtctctgcatgtgagatgggtttcctgaatacagcacactgatgggtctggactctttatccaatttgccagtctgtgtcttttaattggagcatttagcccatttacatttaaagttaatattgttatgtgtgtgtttggtcctgtcattatgatgttagctggttattttgctcgttagttgatgcagtttcttcctagccttgatggtctttacattttggcatggttttgcagtggctggtactggttgttcctttccttgtttagtgcttccttcaggagctcttttagggcaggcctggtggtgacaaaatctctcaacatttgcttgtctgtaaaggattttatttatccttcacttttgaagcttagtttagctggatatgaaattctgggttgaaaattcttttctctaagaatgttgaagattggcccccactctcttctggcttgtagagtttctgccgagagatcagctgttagtctcatgagcttccctttgtgggtaacccgacctttctctctggctgcccttaacattttttccttcatttcaactttggtgaatctgaaaattatgagtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccaatcagacgtagatttggtcttttcacatagtcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcgagccttggctttcagctcaatcagctcctttaaggacttctctgtgttggttattctagttatccattcatctaattttttttcaaagtttttaacttctttgccattgatttgaatttcctcctgtagtttggagtagtctgatcgtctgaagccttcttctctcagctcgtcaaactcattttccgtccggctttgttccgttgctagtgaggagctgcgttcctttggaggaggagaggcgctctgctttttagagtttccagtttttctgctctgttttttccccatctttgtggttttatctacttttggtctttgatgatggtgatgtacagagggtttttggtgtggatgtcctttctgtttgttagttttccttctaacagacaggaccctcagctgcaggtctgttggagtttgctagaggtccactccagaccctgtttgcctgggtatcagcagcagtggctgtagaacagcggatcttggtgaactgcaaatgctgctgcctgattgttcctctggaagttttgtctcagaggagtacccggccgtgtgaggtgtcagtctgcccctactgggggggtgcctcccagttaggctgcttgggggtcagggacccacttgaggaggcagtctgcccattctcagatctccagctgcatgctgggagaaccactactctcttcaaagctgtcagacagggatatttaagcctgcagaggttactgctgtctttttgtttgtctgtgccctgcccccagaggtggagcctacagaggcaggcaggcctccttgagctgtggtgggctccacccagttcaagcttcccagctgctttgtttacctaatcaagcctgggcaatggcaggaggccctcccccagcctctctgctgccttgcagtttgatctcagactgctgtgctagcaatcagcgagactccgtgggcataggaccctccgagccatgtgtgggatataatctcctggtgtgccattttttaagcccgttggaaaagcacagtattagggtagaagtgatccaattttccaggtgctgtctgtcaccgctttctttgactaggaaagggaactccctgactccttgcacttcccgtgtgaggcaatgcctcgccctgcttcggctcacacctggtgcgctgcacccagtgacctgcacccactgtctggcactccctagtgagatgaacccggtacctcagatggaaatgcagaaatcacccatcttctgcattgctcaggctgggagctgtagaccggagctgttcctattcagccatcttggctccacccctgaccttgatcttaaagggtaagatctaaataggtgaaaaagaagatattcaggaacactgccatgagtccaaaaaagggaggtagaaacatcaataacctttcagggctcataagctagtctatatggggaattagtaaaggcacattggttaagaacacgtgttctggaatcagacggatctgcatctgaatcccatttccaccacttactggttccatgatatccaagcaatttattcctctatgctttagcttcctaaactataaaatcatgataatattagaacttatttaatggagttttatgaagataaagtgaaacaaggcatgcaaagtgcttagcctggtacctaaaacatattaaatgctctaaaacatgaagaaaaaaaaaagcaactactgaccaacatgaaaggagtcaatgtaacggactattaagttttaaaactgggttgtggacctaagtgtccatcaacagatgatggataatgaaaatgtggtatatatacataatgggatattattcagccttttaaaggaaagaaactctggcatttgtgacaacatggatgaacctagacagcattatgctatgtgaaataagccaggcacagagagacaactactgcaagatcctttttatatgtaggatgtgaagtagccaaactcatagaagtagagagtcgagtggggagtaccagggtctggggaaaaatggagagatgttggccaaaaaatgtgaggtttcttacacttctctttgttgaaggaccaagcaagtgactgaaacaaataagaattaaaaaatcagttccagagatctgtcgtacagcatggtgactatagttagtaataatgtgttgtacacttaaaaattgctaagagagtagattttaaatgttctcaccacaaaaaaatgctagcatataagatgatgattatgttaattggtttgatttaatcatttcacaatgtatacatatatcaaaaaaccacattgtacaccataaatatgtacaacttttatttctcaattaaaaataaataaataaatataggctgggcactgtggctcatgcctgtaatcccagcactttgagcggccgaggtgaaagtatgcttgatcccaggaattcgagaccagcctgggcaacatagtgaaaccctgtctctacaaaaaatataaaaatttatccaggtatggtggcatgtgcctgtagtcccagctactcaggaggctgaggtaggaggattgcttgagcccaggaggtcaaggctgcagtgagccgagatcacacactggttactccagcctgggtgacacagtgagaccttgttacaaaaataaataaaaataaagaaatttttaaaaaataaagacccactcaaaaaacagaaaagtatattgagaccagttggggacactttgacaataaggctgaagtgtcacaaaggaagttattaaaaatgtgttatctagatgtgaatacagattagaatcacagttgaggcagtaggaatggaaataaggtgtgaaatggaaatgctgttaagaagaaatacaactgcccttaatttaggatttttatttcttggctgcactaccagcataaatcaataaaactgactgttaccacaccagtaagtaggaataaaatgtgatagttggatagtcaagaaaagagttttgtcataatttgagacagatgctagaaatgtataagtacaaaatccgtggctagaaatgtataaatatgaaacctcagccactttatgtgttgggaaatatgtgcatttattcaataaatgcttactgaatgtgaactcgtgattatgacatctcactcatctgagaattacttatcctagaccctcaaaaactttgattcttcaaaacctaggcattaaaaaaaagaaaaacatctcgtcttgttttaggccctcattcagagcttatttgcttactttcacatagaaatgtaatatgtccaagtagccgtgtttttggccacagcaggttcaagttacaaaatagaaatgggaattagaatagtgagactacagaggcagacaaattaatgatagtagaagtgacagctggtagaaaattgtaatgaaaactataaaaagttggcaagagtctgtgataaatttttaggacaaaaatgccctcaaagggccctacaggtatcaccgtattgttcaatatgggaaccccagtttacaactagaggttaatgttatgttcaacagatttccaaaacttcaaaagtaaagctaaacacaaaaattatatcagatggctaggtgctatggctcacatctgtattcccagcacactgggaggctgaagcaggaggatcacttgaacccaggagtttgagaccagcctagacaacatagcaagaccctgcctctacaaaaataaaaattaaaaaatagccataagtggtggaatgatgctgaagtcccagctgcttgggaggctggggtgggaggatcacctgagcccaggggtttgaggctgcagtgagctctgatcatgccactgcactccagcctggacaatagagcaagatcctttctcttaaaaaataacaatatcagagacaccagtatggaaattttttgacaagttttgttaaaaaggagagataagaaatggcgatataagtggataattgataattgaatcaataaaatatttttgttttattttgtcctgttttaagaagggatacacaacagcatgttttcaggggctaagccagaaaaagaggtaaacattgatgatgcttaagagagaaatggagaattgctaaaatgtgtcctgagtaggagagaggggatggaactggaagctcaggtgaaggactgacacgggacagaggcaaagacagctcatccataacaacagcaaggaagcagagacaggagggtgacccgtggagagatgcactgtggggatttgtgcaggtacggggtaggccaccttctggaatgtcttattatctactttcagacaagttaggtcagaggatttctttatggctagctcttacacagaaaggcaggggaaggttagagtcatatttctaggttttatgactgatttagggggaaagggattctagtttctatggcctgccttgggggaagaagtggaacaggagaaaaaagggcaggagaaggccagagagagactttacttctgagccccttctaatgtcctccagttcaaagtactcagcatgctaaagtgccatactttgggatatcgctttctaagcccgaaaaatggcattgaatggtttcctactgattattcgccaatgctttgttcggggtttttcatcctgggcaccgctgacatttttggacagataaatctttgtttgggggaactgccctgtgcattgaagaattcttagcagcatccttgcactctacctactagatgccagtagcaacccccaagttgtgacaatcaaaaatgtctccaaacattgccaaatgtcccctgggtccaaaataatccccaattaagaaccactagcttagtcccaccttgttacaaaatatctagagaaaactaatattacaattcaatgattttttctctatagctaagaaaccgtatttttacactcttgaattatctgtaaataacgtcagagtttttttttattattaaaagaatactcactctttaaaagcaagtcaaatttttcctaagtatataaactgaaaagtaaaatccccactttcttctgccatttttggtccaaattcccaaagacgaccactgctagcagtttcatgttaacataccataattttataaacacaagcatatatgtcttttatcttatacaaataaaagcaaactatatatttttcaacatactttgtaacttaatgatatgccttgaacaacttattatatcagtggatatagatctacttcattttttcaaattgtttaactggttttcaaattgtgtttgtgtgtggtttccttttttgttttcttttgtgttttgttgtttaattttacttcctaaccagacattttagcaaattatttacacacttttgagactgggggcaatgatgtaaaaaaaaaaaataggtgtattgaatatttttcatggatcgtaaaaggacttcaaatgctggaaataagtcatagagtataattaaactcttagtgcttgaaaaagtcatagctgtgcggaaacattataaacattttaagtagaaatgatagatattttaatctgctccgctattgtaaccatgtcactagctatatgtatctcataatatcatgttgtaaagcttaaataaacacaatactttaaaaaaataaagtaaatctgatgcttggcagaaaatattttaattaatttatcaattacactcttactttattttaaatttaagtaaacaaaactacctttaatgcagtgactgcattgatttcagagcaatgatattaaaattttccatattaacatttaatgttgttacagaatgggggttataattttactgagttattgtttacatgagttccctagatacaaattgtaagtatttttgcatttctgtcaaaaatctgtaagagagtaaaaaacttagtttattccactccaataagtcactaagaacttagttcccaagaaatgtgtattgaaacgcttaaggttttagttctgagacaggaattcatgatttgaatataactcaggtaaaattatgtttcctcccaaaaatgataaccagccgtagcatagtcaccttactgtatgaaaagggtgcaatttactcaaaagcacattataaaaatatttccctgtacttgctctctggctttggtctttgaattacattgggacccaaataatgtcaaagagaaaggtgcaatagccgcacacaggttacagcattttttccttctctgtgcaccactcacacagaccccacgaaatgcatacaatgcacacaattttatggtcataggagaatgattcattcttagaaaaaagattccactgatatccactcaatacttgtgtctcacttggcaattggcatacgtgactgttcctctatttttccatctacctaatttcaaaggatttccagaaggaaaagaagatttaaatgcttcatttcaaatatttctgagttttgacaaaggtgccaagaccacacattggagaaaatacagtcttttcaataaatggttctgggaaaataaaatatccacatgtagaagaatgagattacacccctccctcttgcaatatacaaaaaccaactcaaaatgaattcaagacttaaatgtaagatgcaaaactatgaaactactagaagaaaacataaggggaatacttcaccacattgggcttggcaaagattttttaaataacacctcttaaatacaggcaacaaaagcaaaaatagacaaatggattatatcaaactgaaaagtttttgcacagcaaaggaaactattaacagagtgaaaagacaacctacagaaagggagaaaatatttgcaaactgtacatttgacaaggagttgatatccaaaatacataagaaacttaacagcaaaaaaaaaaaaaaaaattgaaaaatggacaaaagaccttaatggatgtttctcaaagaaagacctacaaatggccaacagatatatgaaaaaatactcaacatcactaattatcagggaaatgcaaatcaaaccacaatgagatatcatctcactccagttagaatggctattatcaaaaaaccagaagaaaactagtattggcgaggatgtggagaaatgggaacccttacacactgctggtaggaaattagtgcagccattatggaaaactatggagattcctcaaaacattaaaaatgaaactaccatatgatccagcaatcctactcctgggtatatattcaaaggaaataaaatcagtatgttgaagagatatctgcactcttatatttactgcagcaccatttgcaataaccagggtgaggaatcaacctaagtctcagacaacagaataatggataaaagaaaatgtggtatatgcatataaagatatacagttcagccacacatatattcagccataaaaaagaattaaatcttatcatttgtgacaacatggatgaacctagtggacattatgataagtaaaataagccagacacagaaagacaaattctgcatgatcgcattcatatgtgaaatattttaaaaaggtgataccataatatcatagatacagagtagaacagtggtgaccagagcagagagaaggatggggagaagttggtcaaaggatacaaagttacaattacatagaaggaataaattatagtgttctattacacagtagagtgactatggttaacagtaaattattatacattatgaaatagccagaagagaggcttttgaatgttctcaccacaaagaaatgataaatacatgagatgatggatacactaactaccctaattgaatcattgtataacatagatatatatggaaaaatcaaattgtatccttaaaatatgtataattacaatatgtatgtatcaatttttaaagtaaataatttttcagtatttctgctgttgggatttaaatgtttaagcatgtttccaagttgctctcaaatttttaactaataatttaggtttgtatgtgttggagtagtttttcagttaggaaatttttttaattgataaattccttaaagtatcagtttgtttgtttgtttagagacagagtctcttctgtcacctaagttggagtagtttttcagttagaaaattttttaattaattgataaattcctttaagtatgagtgtatttgtttgtttggaggcagggtctcctctgtcacctaggctggagggcagtagtgcagttgtgaccatcagagttcactgcagcctcaaattcctgggctccaaggaatcctccagcctcagactcccaaagctgggcttacaggcgtaagccactgcgcccaacctatgaatggtttttacacaagatgagaatattcaaattaaaaactgtaattcaaaaaaagtctaattttaagtatcactaaaagcgagatgcatttatatccacattaagtgttaagttaatccatgctaaaagagccaaatgcctcatcattgtcatggagtcaccttcactgactccactgcttcactggagctccagtaggtgtttcaattccattctgagtttcttttgctactcgatctctgttaaaattattaatgtcctgctcccagtgccttagaaactcctagtgcatagatatattcagatatattaaatatttcattgatttgatcagaaagccttcaaaacatcttgagaaatatatctactaagccacacatttttcctacaaggtaagcctactaatacctgcattacataccattttgttaaacttttctatctcacctgtttgttcttgatctgagaaggaacttgttctcacctttaggagtaaataagtttactttttaaataagcaggaaaaattattcaaatgaagccatcaccttcctcattggtgtcctcattctgtgtgctctaatgcttggtgcatacatttgcaaatgcacacacagccgggaggaacacagaaacagtggcaggtagttgcttcctccaattaaacttcatatcagcaaatcattgagccttccttattcatagccaaacaacacacagtcatctaaacagagattctcagtagagagtagcctattggaattgagcaatgggtagagtagggcacatgtggtttggcatagcatattcaatattttaatataaatatatgtttgggaaaaccattcctcattctttccttaataactacaaaaaaataaagctgaaccaaatgttcttggttggtggggagccacaaaagatatatagtcttaagcaaggtatatattcacccctatgagaaatatatcaaaaccttagggaagttgtataaaatacatttgataatcaaaacttaacatagattttgaaggcctgagaaatcctgaattgatataaattctaaacgaggctgctgctggtcatgtatagaaaaaatagcttttgggtacagaaaagctgtagacatgaaagagtgtaattgaagaagcaagctaagtgatcagtatttttaaaactactcagtacattcaaataatatatttattatagaatcaatcaacaatacaaccaaatatgaacacaaaaattttaagtgacagctgtcgtaatattagcctcaacagattttgaaatctcactcttcatttaaacaaagctggaaagatgcttattcaagatctgtgtttacaaaaaaaggttaatctggttgcataagttaaaatgttgaccacttacactgtgttaaaatttttacatatttaacaaagttatatgtgcctttactatcatatttttagtttgaaatgtattttgaaaaataaaattctggctgggcacagtggctagggcctgtagtcccagcactttgggagaacaaggcaggaggattgcttaaggccaggagttagaggctgcagtgagctatgatcatgccactgcactccagcctgggcaacagcaagaccctttctccaaaaaaataaaaataaaattctagtcaaagacttgcaaaaactgatgtaccttcctgaaaccctaattttattcaaccatgtttaataccattagatgaatgtaaccacttattttccagatgatgaaacttaagctcaaaaaatttactgaaggtcacagatctagaaaggtgacaaataaaggctagacccccctgccccgctgcattgattcccaatactgagcttttttcccctataccaggaatagatgtgatttaaaaaattttttcatatacctattacttatccaatattaagacaagcatccgtgagttataattttatggttgatgtatttacgacaaaaaagccacttttttctactttaatgtgaagcacaagatggtatcacgcaaactaggaaggtagaaattcttcatagaattgcagttgtcttttcaatggcaaattggtatctttacacaattctacaataatttttctgttaagtacttctgactgttgcactgatattagtgaatttccataagcttgataggtgaaatcaaactatttaaccttaggtcagagaaacatcagaactatgaatatacattcatgtaacaccaagttataaaatgtttacaagttattttactcagtaaggacttctttcccaaagagtaaagacaacttctattctcctattccaggaaagtttacataatgtctgcaggaagaaaaaggatggaaagctttcctctggctttttctccttcagctgcatggatgtgactaacccaggtagctgcaggtaatgaagctggcaggctgcctgagaccatcctattacactgagcacatcacataaagtattgtctacatatcagtcccaacaatatctccacaccgtaagccatctttttacttcccagacatttctcttggggcttccagtagactgagtcccagagaaagatttgatagctcagggatgatttttttcccaatcagcccaacagggaccactcatcccaccaagcctgaaggcatttgtatggcagttcacacctgaggctcagatagcatggactccttctattgctgtccctacatgccccatcagtctttcacttactccttcaatcaccctttcaagtaaattgccaacatgagctttttcatgtctggaatgactctgcagaaaggacacttcggagtttctcgatgtatcagttaggaattcactttcttgcaacaaaagaaaacctgacccggcatggcctaaacaaagaagcgtttatttttctcacctaaagaggagtctgagtagcctgatgattcccgggttggcattttgtaggtatctgtgggtttccttggtcttgccagcacgtgtgttgcctcatagatgcaaaactgttgctgcagtttcacacgatcatcccatcatgttcaaggcagaaagaaagtggaagacaacagccccatccatctcttgtgtcaagaaagctagcacctccaggacttcctcagcagatgtctgcccacgtctcactggtcggaactgtgccccttagacaccaagaagccggccagctgggaaagaaagtattttgctttccaacttctttaacggaagggcagcaagagagaagggttttgggaatcactgttgaatcaacaaacgaacagtgtttattatacttgggtttaaaattaataatgcatttattatagtaacaaattcaaaaaccgtgtttgccttcagcctttaacttcaatttacaaacctattttctacttataaatcttgtaaaataaaaccaatctccttcactttttagtttataaatgtttaactcaagttgaaaaaattgaacttaaccagtctcattcaagacaaagaataatgaactgttttaaacagcatcttaaatgtaatgattaattttatttgaaatacaagtggattatccctaatctgaaattttgaaatccgaaatgtttcaaactctgaaacttcttgagcactcacaagatgccacagtggaaaattccacacctgacctaatgtaattggttgcagccaaaatgcagtcaaaattgtttcatgcataaaatcattttaatattgtataaacttactatcaggccatgtgtataaagtatatatgaaacaaataaattttgtgtttagatttggatttcattttccaaaatatctgagaatgcatttgcaaatattccaaaatctgaaaaaatctgaaatctaaaactcttatgtttccaagcattttgaataagaaatacacaatctgtatttttttctttttttctttttttttttttttttttgagacagagtctcactctgtcacccaggctggagtgcagtggtgtgatctcgtctgactgcaacctccacctcccgggttcaagtgattcttgtgcatcagtctcctgagtagccaggattacaggcgtgtgctaccatgctcggctaatttttgtattattagtagggacagggtttcaccatgttggccaggctggtctagaactcctgacctcaagtgatctgcccacatcggcctcccaaagtgctgggattacaggtgtgagccactgcacccggcctcaacctgtattttaaatgcatgcttaaaaactttagaaaatccaataaaacgtattttaaatatagtaaatgtcaagttaccttaaatagtccagtgctgcttatacacttaaattctcttacaacgtaaaatcacaagtttgaacttaattgcctgttttaagttgaaattagtaggttcatctgttattccttaattgcctaattctcttaatcataaaaaacactccaaccccccaataaacacgggttattctcacattaaaatataatgccaacactatacatttgattaattttattgtctctatattctaaaatttatcacagtttaaaatacacatatttcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaatacacatatttattaaggggagaattttatcataacagatcaacaagagtttcatctcaaacaagctgaggttacttttgagccaacaattttttttaccaggatatatatcttgagtttcctataactgggatgattccacctgaagcttttgttaaaggaaccccgagtgcacacccatccggggcagttgatcttaaagtacacatcccctgtgttcaagtttcccagaggaaacactttttctttgcccttatgctcaaggactgggaacctgcaaattaaaccaacaagaggctgatttgtatgcatatggcagctaactaaagtaatagctagcttgccaaacagttaaagttagaggctaatattcctaagtaggggaaagggagaggaagaaaagccttccatgggaagaaaatcatttctttaggaaggacaaggggatttttagaagaaaaaacaggagataaagtttgtgatgatgtttctttatgcaggcgcatgtagcctatccatcctttaaggatatgagtttccccagggaagggatttatgacaggtttactgtcagtctctttcctgggagtagactcacccaaaagagggaatttagggaaggattatttcccagaagtttcagattttagtcagataagggaaactctgagaaagcttctttctgcatctggcatctgttgattctcaaatgtcttcaccttaaaatgatctttgtaccaactctggggttctgagtgggtccccacacctgttaaaagataatttaaaaagaagtagaagtgaaaggagaaggaagatgaggtaaaatcatgatattcatataaatataaaataaaaatgtctcaaagacctcaaagactttaattcatttactaatgagggaaccagtaagatgttacaaataattcaaaggagaattcaatgcacacacacacacacacacacacacacacacacacacacaccccaacaggaatactgaaataaatctgattaacacatgcaaaagagaccaataatctatggggcaataatcaatgtatctcacaatctgcatctatctgtcacatataatctgcatttctatcaacaataaatcatttgcgttactataagtattctacaacttacagagttgtaacatatactcataaaacatttcagttagcaatggaacagaccctgtatatgacagcgatcccataagattacaatggagccaaaaaattcctatcacctagtgacattgtagccattataacattataatgttataacattatattatataatgttatatataatataatgttacatattatataacatattatatatataacataacataatatataatgtataacatgttatatataaatgttataatatataacatatgtatatataaaacataattatatactgttataacattataaaagcacaattactttaaaaaaaacttaatgtaaggtctgatcttagaaattttgttattgggctacccaatttacagcctttaggagtcataaatatgacaattccaacactaaactattcaaaagttggcattccagccatacctgaaggaccctattcaatgcaactggtgatcgttcacattcccataacaatatgttttcatattttaccccatatcctgacagttccacatgtagagatattttggaaaagctaccagggtacaggggtgggggacatttttaaattgttatatacaatccctactgtcttataagcagatctaaacacctacctgtggttatacaaatatttggaagaagactaaattactctgcatgagaaataaataaaagatacaggagctgagggcagatccaaaccttgagaacagtggcagccagggaggctggaaactcagtgctggaaaagctgaatccttttcatcctccaagccagagagactccatgacaactgtcagtctaaagaggatagttaagataatttgtactgaaatataaactctgttgtctctcaccctctcaaaattgtcaaccacttaaaaaaaattgtgaaccactgaaatatttaggctggttcaggactaaaacagcattcagggcagatggatagctgggttacacaacgagagcatgtttacttgctcttctaggaactattacttctgtaactctttgggcatacttttccagagggactcaatatcattttttctattgatttgtgttattgcactgtgaattattgctgttcttaaagatatggttccatgctaaaaaggaaatgctttttgttttttactttcccaacgtttccctataaacatcacttactggccccttgcctttctacttctgttcctaaacaattgagttctaaagccatttggtggatcagaaggaggtatttttctgtgttgagtgtgacagagtagtggtccagagaagaatttcggagttccactggggtgagaagggcatccttagagggggctggtgcctggtcctaaacagggtggggagagtgctcatgtaagtgagagtctgcactgagtaaggcgaggagagcatccatgcaggaaagaggatctgtcaagataataaatatattaagttaatagaaagcaagcttctctcactgtcaggaaagggagtaacagatatgtaaagggagaaaattagactgagcctgtagtgttggataagaactggagatgaactcatagttttcagtattagaaatatacagagaaattaatacagatggaaatgtgtgtatgtatgaataaccatacatatatttcctagtctgtccactgagagacctggtggcagtgatactccactatcagtgagcttaccttgtgtctacatcttggcttctaaataccattctacccagagaggacccagagctccttagagaaatggctagttacagggctatagcagggaaaatgcaagatgatcctgaaacatcttgtagtgccagaaagcaaggaagagtgctcaaaaaatgatgcataaatattacaaagacaccaaagctaggttaaaagagttcctactggtccaatttgagacaacttgcacatcagaatacataataataatcaacagattgtaacccattgaacaaaataggaagccataagtctacctgatagaaataagtaaatgaataaattaacactttgatgaggaaagggacttttgcagtttcaaagtacccctctacaaaatatgtattaattacaaaggaatttgggtgaaaccactaatggaaaaaattaatatcttgtactacctgacaggttgaaatgagcatcacttgtgtgaattttatgccaaagatgcataacctgaatctaattatgatggacatcagacaacccaaattcaggaacattctacaaaataattgacttgcatttttcaagggtcaaggccatgaaaatgaaaagaggctaaagaaatgtgacaattaaatgcaaggagcgattccaaaccagatccttttactacaaaggacattttgcaggggcaatatataaactttaatgggttctgaggtttaagtggtagtaacaactccatgttaaattcctgattttaatggttctatttacataggaaaatattcttgtttgtaggaaatactaaagtatttaagggtgctagagcatcaggtcaaaaacttactttcaaatggtggggtggtggggaaatgttctttatccaatacttgcaacttctcagtttgagattatctcaaaattttaaaattatctcaaaattttttttttgagagtttcgctcttgttgccgaggctggagtgcagtggtgcaatctcggctcactgcaacctccaccttcagggttcaagtgattctcctgcctcagcctcccgagtagctgggattacaggcgcccgccatcacacccagctaaccttttgcatttttagtagagatgaggtttcaccacgttggccaggctggtctccaactcctgacctcagatatctgcccacctcaacctcccaaagtgctgggattacaggcataagccaccacacccggcccaaaagttacttttaaaatatcactttaaaatatttaagattcctgatatagctgttgaatcataatgttatgaaaatgtagaactaatttcatgataccgagaggtgacagcgtgctggcagcccttgcagccctcgctcgctctcggcaccccctcgccttggcgcccattctggccgggcttgaggagcccttcagcccaccgctgcactgtgggagcccctttctgggctggccaaggccagagccggctccctcagcttgcggggaggtgtggagggagaggggcaggcaggaaccagggctgcgtgcagcgcttgcaggccagcgccagttccgggtgggcatgggctctgtggccagcactcggagtggccggccggcccgccagtcaggggtagtgaggggcttagcacctgggccagcagctgctgtgctggatttctcgtggggccttagctgcctccccgcttggcagggctcgggacctgcagcctaccatgcctgagcctccctctcaccccgccttgggctcctgcacagccggagcctccccgacgaccatggccccctgctccagggcacccagtcccattgactgccctagggttgagaagtgtgggcgcacggccgggactggcaggcagctccacctgcagcccctgtgagcgatccactgagtgaagccagctgggctcctgagtctggtgggcacttggagaatctttatgtctagctaagggattgtaaatacaccaatcagcactctgtatctagctcaaggtttgtaaacacaccaatcagcaccctgtgtctagctcagggtttgtgaatgcaccaatcagcactccatatctagttaatctggtggggacttggagaacctttatgtctagctaagggattgtgaatgcaccgatcggcactctgtatctagctcaaggtttgtgaatgcaccaatcagcactctgtgtctagctcagggtttgtaaatacaccaattggtactctgtatctagctaatctagtggggacgtggagaacttttgtgtctagctcagggattgtaaacacaccaatcagcaccctgtcaaaacagaccaatcagctctctgtaaaacagaccaatcggctctctgtaaaacggaccaatcagcaggatgtgggtggggccagataagggaataaaagcaggctgcccaagtcagcagtggcaacccgctcgggtctccttccagcttgtggtggctttgttcttttgctcgttgcaataaatcttgcagctgctcacgctttggattcacactgcttttatgagatgtaacactcacctctaaggtataaagcttcactcctgaagccatcaagaccacgaacccactgggaggaatgaacaactccgaacacactgcctttatgagctgtaatactcaccacaaaggccttcagcttcactcctgagccagtgagaccacgaacccaccagaaggaagaaactccaaacaaatccgaacatcagaactctagactcgctgcttctaagaactgttaacactcaacgcgagggtctgcggcttcattgttgaagtcagtgagaccaagaacccaccaattccggacacaatacaatcattgaggagctatatctgccactaaatataaattttaaagactggacataaaaagataatattcagaaaagttatgtggagaagaatattcaaaagagctgcatgaaaacacaggcaggtatggccagttaaaacatcttcaaagtagctgtagctggaggctaattcattaaagaatttttcttaaaatcttggtgtttaaagtgttcttaaaaaattaataaagatataaaaagttagtctcaacacagattggtttatttgtatgcttgagatctctgaaatacgtgatgttctgccagtgatggcctttttttttactttgttttaaacaattggttgaaaaaagattaattttgaataatttcacaagtgagaacattatttgtagcacagctcattattatatacatttgactatgtccttcatcaaactatgtgctctgaaatgactacgtacaaagcctttcatacatggattgcttctctctatgagaatgttaattgccctgttattaagaagtcccgctatacttcacaaaggaagtagtcacttttattttttcatgctttgatcattgaccccaaatacatttttacataataagcttttaatgattattcaaactattctgttcttatttcttcataattataagtattctagaaagttccaaagatttacaaacttggtaaggataatgggagcataactgtactgggagtctacagatatctttgaaattatatgaatctcagattttaaagtgttatagttaatatgtggccaacacaaaaacctgcacacaggtgtttatagcagcttgttcgtaattgccaaaacttagaagcaaccaagatgtctttcagtaagtgagtggataaatatatattagtaagtgtgagaagccagtttgaaaaggctacctactgcatgattccaatgacataacattctggaaaaagaagaactatggagatagtaaaatgttcagtggttaccagaggacttttagggcagtgaaactactctgtattatactataatggtggatacgtgtcattatacatttgtccaaacccatagaatgtataacatcaacagtgaactccaatgtaaactacggactttgactgacaatgatgtgtcagtgtaggttcatcaactgcaacaaatgcaccactctggactggggagagtgttgatggtggaggaggcagggactatatgggcactctctgtaccttttgctctattttgctgtgaacctaatagctataaaaaataaggtctactttttaaaatggcattgttgcccttcaaagtcagaataggatggttatgtgaaacgttatcaaatattcatacctttcaattgtttatggaacaatttttactccttaagtttgtctcctctaattttactattcaacaagtaattttcagcatccctaaccagagatacaaacaaataacgacaagggctttgtttacaatgagtgttcttttttgttggtggggggtggggataagattaaagcattcgaaacaattggacaaccaatatgtgatgaaatttaattaattgattgttagtgtagatgagtgtgtctggtgcaaagaggttaaagtggactgctttttgaagtattgatagttttaaagttcttatagtgctcttcattctattaaatgtttatttgtaggggtataaatatagcaaatcagataatatttcaaaactttaatatttaaattagcttggacactcaaacattctttcctagaaacgcaattgcaaataatgactaatttttcttcaaaaaaggaagtaaaagaatatttatctaataggattagaatctcacctagatgcaagccaataaagtctgagtcaggaattccaacaaggctggagcccaaatttcaggaggaagtgatagtgacgagggggaatggtagtgatggagaaggagttccaggaatcggggaaggtataaaaaaccagaatgggacttctggattgaagatggagtttgaaagtgttgaagtgagtgagaaagtattgagctgagttagaaaactcacatggtgaagctcttgggtaaggatggaaatgaaggcaaatgagctatctttattcttgcaccctacctttcccccagagagtctcagtggtggcactgccatgcttccagctggtcaagccaattcagaacattctgtccatttccattctacccctaaattacatgtcaaatatgttcacttctctcctctccactggcgccattctagactaagcctcatttgtctattacctggagcactgcaaagtttcctaatcagcagcccagctttccctcctaccctcccctcaagtctcctacccaatggcactccatcccagtagccagaattatatgaccaaaacatacctgtttcctaattggccccttggcttcaaattcttcattgattcccctttgcattttaaataaaacccaaacttcttccctttgcccaaggatacttctctacctcatcaacctcagctcatgtcacttgtccctgctcactgggctccatcaccacaaccctcccagagttccgtaatcctcagcctgaagcctcttcctcaccactttaactaccaccaccacttccccactcctacctcccctactctcatgggtgatttccttttcttcctccagatctcagcttaaatgacaccattttacagcggcctccctctaactaccccttgtacaaagcaccagcacacagttattttccattacatcacctgttttctttctttttggacctctccataaattgtaaatatttattaacttgttcaatgtatcctccctgggagatggtaacctcccctagggcaggaactctgtttcattcaatgatgcatgcataaaatcttgcacagggccttacacttagcaactatccaatatagaaatgatcacatggcacctgctttcctgttatcctctatgtcttcttgtttctccaatactaatacaggagttattaagaaattattttaggcagttagggtaaaagaggctgggcgcggtggctcacacttgtaatcccagcactttgggaggccgagatgggcggatcacctgaggtcaggagttcaagaccagcctgaccaacatggtaaaacctcgtctctactgaaaatataaaattaggcgtggtggtgcatgcctgtaatctcagctactcaggaggctgaggcagaagaatcacttgaacctgggaggcggaggttgcagtgagccaagattgtgccgtggcactccagcctgggcgacaagagtgaaactctgtctcaaaaagaaaaaagaaaaaaaaataagaaatggtaaaacagtcctcggtggaattttcctttaataaaaagcagccccaaaccatttcttttctaacagaagcagcctgaaaagtcaagctgcaagcacagatatgcaagctggaagctttcgtatgtaaatgtcagcagctgtacctggaagccagatacattcaatgtggcgattcccgctcccttttccttatcaccatgtgtgtgggtatcacagcactggccaggtaaagccatgtgtgcaggtgtcagggtgacagccaggtagaagccacatttgcataataaaagattagggtgggagggccagtcttttaggtctttttgcaggctatgtaaatgacacacctggtgaaaccaatcccctgggctctatgtaaatcaatcaccgcctcctcaagcctctgtacaaaatcaatcgtgttctgccccaaaacccggaaaccctctcttgggccaccggctttctcatcatgaggaaactttttctctcttcttttttgtctattaaactttcctctccttaacctactccacgtgtgtgcccgtgtacttaatcatctcagggtgagacaatgaaccacaggttttccacagacaatgaagtcgtttcaataccagaccagccttgattctgagcccatagtaagaatacaacaaattcctgtttttaaaattattggctgaaaattgtttgtagaagacggtaattggattgaactgtgaagtatgggcagacgtttcatagaagagaggaatggagaggcactccgggtgggaaacagcatgaacaaaggcaaagaggaaaatgttggcatcttctggaatcatggaaagaacgtcctaagaggtgaaggttcctagaaaataactggcatcagggttgtatgtagaaaccatgatgagaaagacaaatgattataaaatatcagggagaaactgctctttgccacgcctttgtattaaccaccttcaaactttgtgtcttctccccttttcctcagtttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggtgagtgaagcccctgcagtcacggtgagagaaaggagcagaaaggactgaaggtgaagtcgctgagacttctctcaacaaaaagacaaaactaaattgaaatacaaaacatatgttgcttaaggaaatcttacacttatttcagtagcttaaaatatccactcttttcttttcttgtttttgtttttttttgagacggagtctcgctctgttgccagtctggagtgcagtggcgtgatctcggctcactgcaacctctgcctcctgggttcaagtgattctcctgcctcagcctcccgagtagctgggactacaggtgcccaccatcacgcccggctaattttttgtatttttagtaaagacagggtttcaccgtgttagccaggatggtctcaatctcctaacctcgtgatccacccacctcttcctcccatagtgccgggattacaggcatgagccaccgtgcccacccttaatatccactcgtttccatgtaatggtatcacagccaatattccaggcgagtggtggttgctcacagagtaagttttaaccaagattgtccaacccgcagcctgcaggctgcatgcggcccgggatggctttgaacgcagcccaacacaaattcataaggattttgaaagcattagattttttttgtgattttttttttaagctcatcagctatcattaatgtaagtgtattttatgtgtggcccaagacaactcttcttccaatgtggtccagggaagcccaaagactggacacccttgttttaacccaacaaacctgcccaagtaaggtgttagaggcagaatacggttgaaattgagaatacgggctctggagccagactgcccaagtttgaacctgggtatgacgataagcaattatgtaagcttgagaacatttcctagcctctctgtacctcagtttcctcatttcataaaagggcatggtaattgtgcctatactctaagaattcaggaagattaagggtacagaattagaagagtactggacatctaggaggtgctgtccaggtgttggatgctgttgccctttcttatcttttgggacgaaaagtgagttcttctaaaagagacaaaacaaacaatatgtaaatacaacttacttcctacttaaccaacaaccatacctctggatttataaagccagtaagtagggcttctggccaatttgaatatgggaaaatagctttcagttagaattttgttcaaacttctgaagccttgaaaatacaaagttagaacctgaattgtttggatctgagtcactgggaaaataaacttcggttaataatgtaaagtagtaagatttctcacctgtcaagaaataaggtactattttgggaggactaaaagatgcataacaatgctattatgcaaagtgtcacataaataatatatgctaatgaggccttgctgtgatcactcccccaagtatttcaggctttttaagaaaccaccttgaaggaattaagtttccgttaacataaaataagatgaacacctggcttgaaaatcctcctacttgaaaaaaatcagctaggtcacacaagcagaccttaactgagctaatttcttgaatgtaactgaaacttaggttgtttcttgtaaatgcctctgataatcacaaacaaaacttaaattgtctttctaaagtggtataaggtaaatcacttttaaccagtccgctatcacctggaaaccccgttgtaataaccagtcatggaaaaggttgaagaaattcctcattttcactttatgagcaatcctataatacatgcctctgagctttcttactgcctgggctgaaatctccctgatatcgagctgtactttctcttactgtatgataataaacttttaaatttttataacttgatctgattttatttttgccacttcttagtttgaaacactatttctatgtgatggcagtaactcaagtataaccacactatctaaactagtgagcttaagctgcaattgtatttgatttggatggctataaatacgttttcatttatttaaaaaaaacaacgtcttgttaaaataaattaatattacataattttttaattagatgaaacagtgttttgcccactgctagtcagttccccgtcgacctgctggcagttcaaatagagagttctagacagagcaacaggaaaacttcactccaattaaaatggcagctggaagcaggaaaggaacgtggtgggagtagcaaatttaccagcaaatgtagcttctcagtggaaaaaaagcttgggaactctagctttagtgctaagtttaaagaggccaagtagcaaaagtagcaatccttacagtaataatccttaaaatcatgcaagtttctcaggattcaccaaaaagcacatttagacagaggcaatagggcattggggtttcagagagaagtttagaaatcagagttaaactctagctataaagggaggcaaaaaatggcttgttttcttttctataaaacaggaataataagagtatccatgttcatgggttgttaacaggattccatgagataatgtatccgagatgcttagcagagtacaggtgctttggactgaatgcttgtgtcccccataaagtttatatgttgaagccctatcccccagtgtgataggatttggagatgggatttgggggatgtaattaggaatacgtgaggtcataagagtggattagcatccttatgagtcctaagggagcttgcttcatctctccaccatgtaaggaaacagcaagaatactgctgtctgtgaaccagaaagtgggccatcactagacatgactccaccagcaccttgatcttggacctcccagtctccagaactatgaaaaataaatgtttatgtttaagccacccaatctatgatacttagttatagtaacttgacctaagacaataggacatgaaattagcactcaataaatgttacctagtgttatcagttagctgtaattatattacaaacatagtggcctaaaacgtaaccatttatttagcttatgattcttggggtcagcaattttggatggactccactgagatcagctaggcagttctggtctcagctggattttctcaagcacctgcagtcatctgtggatcagctatgccatgatgcctgggaccttgtctgtgtccttaattcaccattgccaacgtttgaaacctctcaagtccagttttggatatctgggaaagatcataattcactcttataaagacatgtctatgtaaaaaataactatttcaatttgttactgatcttcttatgccagaatcacataactttcttgaaattcacctagaccactggatctccaaaagtagtcctgagaccaaattcatcaacattacccaagaagttgttagaaatacacattttggccaggcccagtgactcacacctgtaatcccagcactttgagaggccaaagtgggaggattgcttgagtccaggagttggagatcagcctaggcaacatggcaaaaacctgtctcaatattttttaaaaaagaaaaaataattattttaaaatatttatataaaaatttaaaaaaagaaatgaaaattctcaggctccatcccagacctattgaatcaaaagctctgttttaatatgagcctcgtgtcattctaatacacgctaagttttgagaaccatgaacctaaacccaatgagcagaaaatcaggaatgcatgcaaaatggtagcaacagcagagatacattagaatcaagttttcaatatggtacacaagcattctaacttgctcacaaactccattattatcaattatctacaatttttagctcctctaggaaaaccggtatgctagtagtggcagtcatctagaaatagaaaaaaaaaattaattccgttcaaaacctcaaagatgcccagttggcatgctgctgctgtccatgcaaaaatagactggaactttccaggaaggatggcagaatttcatcaccatctttagagtccaggtgatggaaaaattatgagatgcagttatttctgtttgtctctaattgctttaatttcccttgcaaactgagtggttttttccttcattttatagtatctggatcatttatgctcccaaggctgttcttttcttcttcttcttcttcttcttcttctttcttctttttctcttttgagacagtctcattctgtcacccaggctggagtgcagtggcgtgatctcagctcactgcaacctctgcctccaggattcaagtgattctcctgcttcagcctcccaagagctggggctacaggtgtgtgttaccatgctcagctaattttttgcatttttagtattgatggggtttcaccatgttagccaggatggtctcaatctccagacctcatgatccaccagcctcggcctcctaaagtgctgggattacaggcatgagcccaccgcacctgatcggctgttcatttttaaaacatccatatgtaaattctgtttaatactaattaaattaagtcagaaagttgcttcttttcagaatatgtaaacctcatgcatattttccgtcatgtaaaatacaatatcttaacatacaaatataagaaaaccccataattaaaaatcatttttagagtaataacttacaacttaatagtatattgtcaaataaaataccttcttttaatgaaagagttttttcttaattagaccttttaaggtatatcttaaactccaaaaacctctcccttattctgtcaagctatttaaaccttgacactaataataattattaaaatggaaaaataagtcaaatggaaattgtagaaataaaatttagggatatcgctgaaaaaaatgaaacaccaaatgaattaaactgagtctctatatttgaactaatacatgaactaattatatttagaaagaactgtcacttttgtgttatcgcaggcactttaaacaagtactcttatttagtacatattaaggtcccagttttctcagaaaacccataaataattaatttccctgtaattaaacactttattaagtataaaaaataaaatatttcagcacaaagagcatgacattaactcagtgaagattttttgtgaacacaatgcaagcaaaatcaatagatttaaaatttttcagttgaattcatatgaatccttttttctaaaatatttacacaatatggaatttacatgtatacagacatacatatatcaaaaactgattacactatttttataataactttgatccttactggtgaacttcagtatagaaatgtatagatgtttcctgagttatgcaattttatatcattcccatataattccatttgtttttttgccatgtgtcactaaaccattcttcatctctgctcagaactgtcacagacacaatcaaacagcataaggaccaaaaaaatttttttaagtcatcagagcagtgtttgatgtgacaatgacaaacccaaaaggagggacctttcagtttttcagctagaactatgatacctgagagaatacatctgggtaaataacaaaggaacctgataacaaaaagttgagggttcttctttaggaatcatctgtgttcattttcaaatgagtgcaagctcagtagtaaaaatgttaaaggaacatcaaattctcagatgctgttaaattagttcacttcctctagatttgtatttaaaagaaactctttacgtttctagattagaatttgctctagcattccttctgtgttataaacagaaggctgtgctaaataagggctccccctcatggttacactaacccaaccttatctgagagacaggttgaattactgtaactgggaagactggctttctggtgcctccctactgtactcttgttctttagcactttagcagccttgtctacaggaaaaggataaaggcctttgtcagtctgtttacatattaccaattctataacccataggggaaatggaaaacctcttctaatacattttgggtcgtgtagtgtgttagtatctgccaaaaattaacgtgcaaataatgtgaccttatttggaaatagggtctttgcaaatataatgcaggtaaagagtgacatcatactagatcagggtgggccctagatccaatgacagtgtcctcgcaagagacaggaaatggcatacagagatgctggagagaagagggctgtgtgaagacagaggcagagactggagcgatgctgccacaagccaaggaacaccaggagccatcagaagctgaaagaggcaaggaaagattctccccctaaaccttctgagacgctgtggccccactgacaccttggttgcagacgtctggcctccagaactgtgagagaacaaacttctcttgttcttgtttttttgttttgagacagagtctcactctgtagcccaggctggagtgcagtagcacaatctcggctcactgcaacctctgcctaccgggttcaagcaattctcctgcctcagcctcctgagtacaggaactacaggcgcatgccaccacccccagctaatttttgtatttaatagagatggggtttcaccgtgttggcgaggatggtctcgatctcttgacctcgtgatccgcccacctcggcctcccaaagtgctgggattacaggcgtgagccaccgcagcctgcccaacttctcttgttttaagtcaccaagtttgtgggaatttgttacagcagccctggggaacaatgcatgttaggacagtttgtggagaagggccatcttctgtgggcctaaagagacattattaaggtcgacataaagttctggtccagattaaagcaagccttagaatttagtcttagtggattttagacagaatttccaatgagctgttcttacgcataattgtatgtggtataaaacctcctaaagatgattttgcttcactgttcacttgcagttctgggttgtgctaaacttgaaccacatggtttttaccgggtgttttgtactcttttatgttatggtgagtcaggtatggctacaagagacaccagggaggctcagaaacacaaaagtttattattcccacaggttctagagacaggaggcagggcataccatacagggctagatgggaaagacaccaggatggtcaggaggcagaagacgggtgagaggggaggcatcaggccagagcctttattggggtttctgagggaaacacaaggcagtgcagggtgagcagcttaagatgtgctggtttgaataattttggagggctctaaacattagcagtggtccttacttcccagctacctggccctaggataatgaggaggaggactattgcctccggggtgtgtgggctaatcagaggagctctaggtctggattggttagtttgcatatcaaaggcatgctctgagcaccctttgctctctaagaactgacaagccctgggaaagacaatctcttactagcctagaaaggttttttaaaagatgttaaatatcataatatacagaaaaaatgtttaaatgtacaatataccaagtctttcttgagttcaactttgccagcacttccctccctgcctcccacttctcaaatgtacacagaaagttgcggcaacaaacaacagtaagtagagagtcacctttaccatgtagcaaaaactgccctctgcctatgaatgcttctctgggaagctccttgaaagtatgaacattttcccacgtaaagttttctatttcagctccttcccaatgtgatcttaaatgctttgccttccctccccactgcggcggactttgttgtctgttagtaatagtttactttgcaattttgccattcactgaatattttaggtttgaaaagacatcttatgttctaggtttgtctatgcatgactactttttttattattatttttgagactgagtcttgctctatcacccagactggagtgcaatggcgcgatctcagctcactgcaacctccgcctcccaggttcaagtgattctcctgcctcagtcttctgagtagctggtattacaggcacctgccaccacacctggctaatttttaatagagacagggtttcaccatgtggtccaggctgctctcgaactcctgacctcaagtgatctacccaccttggcctcccaaagtgctgggattgcaggcatgagccaccatacccagcctgtgcatgactatttgtgacactatattctaaccctcctaggaatatttggttttgtctaataagagttgtaataataaaattaatagtgtcttatatttttttagtatttattatgtttcagacatagtcctaatcctttaagcacattctctcattcctcctcactataaattagatatgatagactatttccattacacagggaaggaaaatggaagtacagagaggttacataactcttctgacatcatggtttgctcagaattcataccaaatgcttggcttgttctgttttgtttttgtttgggaggaaagaacatgcttatgatgttaatcattgtgtagtagggccttcaaacaaatctcttattgataaaatttgaattctatgaagtcttccctttaaggattttggttttaaaaaggtaaattatttttaactttctttttaaaatatataagagattagatgaacttccaaacctaaaattgcaagtataatagtatgaataatgagtagtatttttatagcagtttccattttgagtgctttatacattttacctcatttaatcctcatgacaacccaggagaaagggactgtttttgttccctttaaagatggagacattgatgcactgcatcaatttcatccaagtcatggatgtctgttttgccttgttataaaggaatagttgtggctgggtaatttatgaagaaaagaggtttatttggctcatggttctgcagactttccaaaaagcagggtaccagcatctgctcagcttctgatgagggctcaggctgcttccactcatggcagaaggcagaggggagccagtgtgtgcaaagattacatagcgagagaggaagcaagagagaggaggggaggtaccaggctctttttaagctagctctcttttgagccaatagagtgaaagagaagtcgttcaccctcaagggacagcattaatctattcatgagtgacccacattcatgatccaaactaggacccacctcccaatactcctaatactaccacattggggattacatttcagcatggggttgggtgggaacaaacagccaaactatagcagtagacatgacaatcatttcaagttctcaagtgagtgagaaatgtaaatcttcatttttctatggccaaaggtaatttctgctacaagggtccattcttccaagtggtagaagtctaaaccaaggcagttaaaggtctgattcatttcccttcacctggcattgcagttgagctcagcagtctctgtggtgccaggacattgtgtgggggttctggttgcctgttgtcagctgatgatggcagcatcccctcagatgtgcataaatccatctggtcctctgccgtaagtcaccactctgtcatctcctgcctgtcttaggctctttcacatccagtgcctctcctgcctacatctgcagcactctggggctcacaggaaacatttagtacacctgagccaggctgagcccaggagaattttcatgctcatatttaggtccatctgcctaggcccttatggccatttctcctctactattcctgtgtcaagccagagtgtgcaataattctgtgggtcctgccatacatatggcctctacttagcaaaggacaccaggctacccctgtacccagagcccagaaaccaatatgggaaatgtgtggtttcccctagattcagcccaaggaggagggaaggaagaaagacccctccactctctctggtgcaagtctcttgttaagtctgggaaaagcaaagctcagctcttctcttttttggtcttccatatctattgtcagtaatcaaatttaagcatttaaaaatcaaataccaagaaatttgactaccttattatctgtaaacttctgtctcatccctttcaggcaatgaaagtggttaattctagctgcctaggataggaaaaggagcagaaagtgcaaggaatttaagagaaggaaaactttgttaatgccccaaagtatttttcctgtcactggcttggcacttactaatccatgagaattagataagcagtacttatttatgggtgtgatggtgatgatacatattttcaaatcagattacaagaatgtttgaagtatgtcaagcagttttaaaattttcaattggtcctgtgtttaaaattctggaacattaattattccattatttcccaagtacaacttactatacagctatcagaatgatggcaatgccaggtggtttgatggagacattagcggttctcattttagaatattccactaaagttggtggtttgtcttgttttcaagttaaaaacacagaaggatacacatcacatgcctgtatcaaaatatcttatatgccccataaacatatagactgaccatgtacccataaaaattaaaaatgtaaataaaacacaggaggaaaagtgatgtgtcataaatatgtgtattaatgcacaatcatgcattgtattttcaaaattttctggttttctatttattattctcaaaataacattgcaaatacctaagtagctgaaccctaggcttttctgaaaatacagacctagctttaacctcaaatttgtttatttgtgttttatgatacttaaactatgtatggcttaccaccacaaagattttcctctcagaacacttccttctatatggcacagaaaaggtaatttgttagtggcctcaatttcctttaaaggatgcccaggataatgtcacatcctttgatttccataaacagttgcctccaaaaggtattaagaccccagaaagaggtatatgtattctgtccctcaaactgctgttgtcattaaattcaaagaaactccacacagtttgatgaattgctctgcctggccagcctgcattccagcgtttactctggtggcctagggcacctctgctcttgtgggtaataacctcattttactttatgagcaaaagatgttccactgtgttcgaagaatgagtactgaaagttgactaaatacgtgagaatcagaaatgctccactttagggccagacatggtggctcatgcctgtaatccgagcactttgggaggccgaggtgggtggatcacaaggtcaggagttcgagaccagcctggccaacatggtgaaaccccgtctctactaaagatacaaaaaattagctaggcatggtggtgcatccctgtaatcccagctactcaggaggcagaggcaggagaattgcttgaacctgggaggtggaggttgcagtgagccaagatcatgccactgcactccagcctgggcaacagggtgagactctgtctccaaaaaaaaaaaaagaaaggctccactttgcataaatacaagccttataaattaaccacttatttattaatcaataagcatgtacacttattaaactatcacatttagcctttcattttcataaatgatcataccatttaacatgacatcatcacacactctgttctggcctctgctctgacagagacataagtccctcaaccaaacatcaagggagcccaggagtgaccctgcaaatcgacaggaatgtttctgaggactacctgcatctgagccacctggggggctgtgaaagatgctgagtcctaaccccccaccccagaaatgctaatctaataagtaggagtaaagcccaggaatctgcatttttttaacaaataccacagatgactatcaaaccagtttaagttttgaaataattcatatgccaatggagacaattttattatccaattcataacacctagaaaatgattagtctaaatcagaagtttttaacgttggcagacatctaatcacttggaaggctcgttaaaacatagattgctgggctctcaggttgcagagtttctaattcggtgcatctgaagtaaggcccaagaatttgcttttctttcaagttcccaggtgatgctgctgctggtcccagatatacacttttgaaaaccactgatctagacgatctagacagtcttcttgtgcaaatgcaaaagcaaacattttcaaaatgtactaataggtgtcatatggaaagagttaaacaaaattaaagctatttctttattgcctgagttctcatttcatcataccagcatgcattattaattccaagtggggatagaggatgcagcatttcccaaacatatgttaccatagaactctcttctcaaggatattcctgagaaactatttcagaaaagcctgataaagcactgtgacaagttaatgcatccaagaaacttggaagtttcctgtccccaatcaaatctcatcctttgtcctcatcccccagtgccagtgccaggggaatctaacaacatggggggagagagatgccttctccagaattcaaattggtatgcctcacccacttttccataaaactaaattataactaatacttggtacaaatgaaataatgttcatgcattttatgtactttaaacactttatgaggactagtaagagctagatttcaatgatattaaaagtaccttatgacattttgagctggatgataaaagaaaaaaaaagataaaagtaccttagtagtcactgaggtatacaaaaatacataggtaaaaaagattttctactatactctcataaagagataaaatatatacatcaataagcatagcatgaagcagattacagtaagtataataagaccgttataagcaaaatgtccttaagttggggaccacccacattaatcttatttgagtgtcttaaactacttgatggtcgacatctagcaactttgcttaaaagcaatacactccgagtcacaggatttttctgtgactaaattctagctgtcctccaatgcaatgtgagaaggaccctagttgactatggcaaatcccataatgcagttcttccaaaacttgctttaagactaacctaggccacttatgaaaaatatagatttcccagactccatgctgaccaaataaatgagagtctccagtggagaagcctgtaaatttgtgttttggataaatgccccagctctcagtttttattttagcataagagagactgagctttctctgaagtgtctttaaggacagaaatccaatcattcattcattcaatcaacaaatatttagtaagctcatgcagcatgcaagatcagatttttcttaatctatgtttttagactttatttatagcatgactatatcatttttagctgaaaagctcttttttagtaaaaatatttgttttattggtgccatttttacaacactacccatatatactggaaaccatatcccctaacccaatattctcttctgtgcggtgcttgttccactaccctagactgcctcgagataaatcagagaataaatttcatcaggatcattactgaagtatgaaaaaccattttgatcactgccctatacatccttaaaatatgaaggacacaggatttaaaatatagaaacacatataccaaaagctgttttctttaaaatgctaactctccaactttgcaattttggcaacatttcccatgttctatatttctgctttctgccttctggtgggaggaagtaatgggtagaaagaggaaaatactttggaaaggcagaaagaaaagtaaaagcttattactaaaaggcttgtttgtttgatgatgttgctatttaatgaacacaatggtgaggacaaaggattaggaaattgcacatagcccatggttttaagcatggcattatctattaatggtaaaaaaaaaaaagaaaatcagcaaattgaaattgtctatttgtaaaagctcagttaaatacaggatctgctaaagaagccgagtgaaagaaaatcagcatctatggcagtcacccagccacctctcatgaatttcctagcagcagtgaaacattacccacaaaacagccctgtgttctgggatgctgtcacttcacctaatttccatcactgatcctgaggtaggtggatgtggcagtaacaggaacatgaacgtggtgcacagagtgaagcgaggccctggtaggctgcaaggtcgaagccttcaaaccttcacaagcccatttctcactcaccttctgcagatatgcatgaagactgtttatatgaatactcaaagcctcaacatactctggcctacctacttacatgctttatttgtaacatcgataaacatataaccactcataacactactatgtttttggtaaattgtttttagtaataccttgatttgcaatactttcattgatttcataaagaaaaataatgtgaatttaaattccagttaataacaacttctggttgttatttaaataaacttttttataattcacacaatactgatgtaagagcctcaataacagaagtgaaacagacaacagaaaaataagcagcaaatagtaatagctaaatacttaaagctgatgtcccacaaaaggtgaaattctatagatagaatgtaaacattacataaattctttggcctagaaaagaaatacaataataatttatgattttaattgtttagttatttttaataaatctgtttcttagtcaggtcacctaaccttcttcagtatcaatttttctatctgcagtatccattcttctatctgggtttctgcttatatatatctgtaagtggagatgatgataatgaccaaatgtagttatgaggataaaatggagcacctagcacaacatgatgggtacttgctaaatatgacttctttcagggctaaatgctagcattcagcctctcttaaaaggggtgaatgaaagtctctcaaagaattctccttatctaaagatatgaaacaagtttacaaaagtaaacttgccaaaaggtcaaaaaactctgcaaaactaggaaaggaagacagtccaatgccataaatttccaaaatctcaaaacctgacagccaaggaaatatatggtgattccggagcccagtagaacagaacattttgtaaggctcctgatcccatccccagaacccacgtgactcttttttttaggcaaccacaaaattaaactacactaaatttatgggttcagaaaaaatgcactgctttttcaccctcatgagattccacttgagctccccaaattaactaaatgtctaatcattgttccgccgtactttaatccaatgattcagtcagcctccccacatctgtcattgttaaatggaaaaaaccggaaactactctaggtatattagacagaaattaggtaagcagaatcttctcagaagggctggaagagtgggtgtaaacaaagttgacatccatgctgttggatccatcatggctgcgactgacaacggagacagctgctgctcccgcccccaacacagctgcctctcttgacacccacaaggctggtagtacctgaaatccccttccacaattgctcctatgtttctgttttagacagagcagcaaacaaatgaccttatacctctcttctaaccaagatacatgtgagtggatcccaaatcctggctctacaggaggtgtgaaatgttgtctgaagtttttcagtctctgctgcacaggaaaacaccaatgaagttgggtcaatctacagcatattccatgacaggttccttgcagttgtacaatacaatggctgttcctcatgatctgttccattggtgactcaacatttgtatgcatttgctcctcaattgcttttcgcctaggccagcattgggttcagatttcagtcaacaatctagcaaaactactgcttgagctaacacatggaatccagaaactccaggaggtcactgtattagtccgctctcacgctgctatgaagaaatacacgagactgagtgatttataaggaaaagaggtttaattgactcacaattccacatggcttgggaggactcaggaaacttacaatcgtgaccaaaggcacctcttcacagagcagcaggagagagaatgagtgccaaacaaagggagaagccccttataaaaccatcagatctcatgaaaactcactcactagcaggagaacagcatgggggaacacgcccccatgattcaattatctccacctggtcccacccttaacaagtgggtattattacaattcaaggtgagatttgagtgggaggacacagccaaaccatatcagatacccatatcgattagctttgcctaacctaaagctatatttctacttcctggtctaatgcttgcagaaaccattctcatgcaaattccttgggtttctgcttttataaaatagcaaaatcttttggtatgtcagtcttctctaagtccaatttgtgttctgcagcatgctgggctctggctccagttataataggttgagaagcaaagaagcctggtaatgaaagggcctgaggagagttggcaacttatttacctcaagtaaagtaactcatgtgtcttcaaacaaactacaactaacctcatcagacaggaaaggggagctgcttttgcttgcaagggaggttttgtgggaaggggatttagagtggtcatatttgactgaacacacacaaatgtcccagtgcaattcacaaggtctgtcttgccaatcagtgttctaatgttcacttaaaagatatgacagacggagcacagtggcccacacctataatctcagcactttaggaggccaaggtgggaggatcacttgaggccaggagtttcagaccagccttagcaacacagagagacccccatctctacaaaaataaaaaattagctgggcatagtggtatgcatctatagtcccagctactcaggaggctgaggtgagaggatcccttgagcccaggagtttggggctgcagtaagctatgatcacaccactgcactctaacctaggcaacagagtgagaccctgtctcaaaaaaaaatttttttaatgatatgacaaaatatgaattcaacttatactgtaacttaacaacccataggatcagattctatataatgtagggatacatcagtcctaagctaaggccacaagaaataaaagattatctgagggtagttctatcacccaggctggagtgcagtgtgcaatctcggctcactgcaacctctgccccacaagttcaagcgattctcacgcctcagcctcccgagtagctgggactacaggcatgtatcaccatggctgggtaatttttgtatttctaatgggggtttctccaccttggccagactggtctcaaaatcctgacctcaagtgatctgcctgcttcggcctcccaaagtgtggggattccaagcatgagccaccgtgcccagctgtttcctttctttaatctctccagagctatttctttagcaatcccacttcacaacccttgaaatttctcattctcattctaatgatttatcgtagcaagaactttgccagagtctagccttctaacagacacatcattccaggaagccatagcaataatttaagtgacttctttttgtcactgtgtaccattaattatgagagtcccaagttctaataataacatgattgccgttatctgtaagaagaatcggaatagataacccatccgatgtttccatccttgagatgtctgagagtctgttatctgtaaccccttctggaaggaggaaacagaaaccactctagatatttttgggaaagagaagcttaagaaaaaaatatattttatacaggaaaaatgtgtttgtagaatcattttaaaggctgcggaaggagtcagaggtagggaatacaccactgtatagttgcaagcccaagatcaagaagcatttgcttctgtcacaactgctactgctaatcatctctacatccatgaaactgggaccctgaggctggctgcagtaactgccctaactgccactagatatccatgaggctggtgtgtataaacctcaggtctcacaagagtgcgtccaattggtagaagcttatctataacaagaatcctggctacttagggtctggaaaacatatatttaagttaccaacttctgaagaatacgaaagcattctaaagtgggggtagaataaaagaggagcaaacattcacaaaagccaccacagtctcaggaagttttagtctctatttggctatatatgccgactctttcaaatttccttctcctactcctgtttctctgcctaacatatcaactgatgcatgtgttaagagttgggcaggcaccttgaacttgttcctgggtgttcaggggctggtatttgctggtttctggggcactgtcccttgtccacgaagttactgatggccttctagagtcccatacagaagtctgcagtggctcacgcctaataatcccagcacttttcgaggccaaagcaggtagatcacctcacccgagaagttcaagaccagcctgggcaacatagcaaaaccccatctctacaaaaaaaaaaaaaaaaaattagtcgtggtggtgcacccctataatcccagctactcaggagcctgagggaggaggatcacttgagcccaagagggagaggttgcagtgagctgagattgcaccactgcattccagcctcagtgacagagcaagacgctgtctcaaaaaacttttttaattttaaaaattttaaaagaaatcaatgctagacttaatactaacttacagaaataggacaaacttttataacttcactctctgttcatatgtttgggcatccttagggagtcctggtagcattcaggaaaaaatttagaaggtctagagaagatcacataccaacccctaccaagagaatgaaggcttgtaccatgtgcagagatccccagagaaactgcttcttcatccctgttcactagtccactctatcacttgcttgactgcactgtctcttatgtttcaaagtaactaaaagatcattaggaattttgtgagaaaagcttcttccttttatcccacaaataaaatcttctatttttttaaaagtgacataggggtttaaaatagaaataagaaaatatagaaatatatatataagcactcagagaataatcactttagataccatggtgcctttcaaaaaagaaaaagagaaaagaaattagatcatgccagtcatgttttctttctttcttaaaagttaatcggccaggcatggtggcttacacctgtaatcccagcactctggggggccgaggctggtggatcacctgaggtcaggagttccagaccagcctggccaacatggtgaaaccccgtctctactagaaatacaaaaatttgctaggcgtggtggcgggtgcctggaatcctagctactcgggaggctgaggcaggagaatcacttgagcctaggacacagaggttgcagtgagccaagatagtgccattgccctccagcctgggctacgggagcaaaactccatctcaaaaataaataaataaagtaacataaaaaaagttaataatcatggctgtctagccatgtttatacatctccaacatcagttttagagattgaagaagatgtagggaaacataattattgtaaaatactaagaacagtgtgccatatttggatatgtctaaaatactgcttcttaaaacgtcaaaatattacttacttcaggaacacctatagtgcttgttaaaaacagagaatagtcagggcatggtggcgcacgcctgtaatcccaacactttggggggccgaggcggacagatttgaagccaggagttagagaccagcctggccaacatagtgaaaccccatctctactaaaaaaaaaaaaattaaccagatgtggtgtcaagttcccgtagtcccagctacttgggaggctgaggcaggagaatcacttgaacaagggaggtggaggttgcagtgagctgagatcgtgccacagcactccacctgggcgaccaggcgagactctgtctcaaaaaaaaaaaaacaaaaacaaacaaaaaaaactggagaatggttttttcataattcactcccccaaaatgtttttaatcgaaataattaaattaaatttaaaatggtgactagggagcccatctcagactataaaatgagaatctccaggtgggggtccataaattcacgtttatagcaagtttccagataatgtttatctcgctacatttggagaaaccactggactgttttaaagagaggacctgtctccccacaatataccagaatatctctgttccttgaacttttttgttctctgatttttattttaggagacaacaatggatggtctctgcaatttgacaaatattttgccagttactacaaaatgacttcccaatatccttttgaggcagaaacacctgaatgttgtaagtaatcagagcagttattttcttttccatgagttcataagacaccatttttaaaagtttgattcaacattttaaaaaaagattgcatctcaatctggaaatcagttttaattaaagaaacttaaaaattcgtaagaggtcaattatagttttctaattgcaaattctattaaatatacaactttaactaggaaaatttatttcaaaaaagactcagggatcttaagtgtagaagtaataaatggtgtcagatattgttatgaacagaatcaatgtcagtcaaggatgttattttatatgacttctcttttcacaatcactataaagtgtgatgtaaagaaaacagagaaagtagagagggcagaaaagctgtttggattttaatgtttgctagaaaaaattcttctgagctgcaaaacccttattcattataacccactatgttcagtcatacactgaaaacttacaaaaacactggaggggtatggaaggtataaacctgaggattaactataatattttagatcagaaagatatatgaaaataactcctcttaaataaattttgtcagttctaatacattatgcaaatgtaaatctgtatcttggagctgtcattttgaccctagcttttcaaaaccttggtttaaaagcaaggcatatttgctattcctctgacattccagacatggttccatatcacagcctctatacagactgttctttgagaaactttctcccatgtatctgcttagttggtgaccctcagcttattcagggccctgttcaaatcaaagaagactgcagtgataacgctgtataaaacagccgcgtcctcagccctaccctcattactctatgagcttactctgtgttattttctggggtggcactatcataattgctggtggtagtggtgctggttgtggtggtgtatgaattatctcatcagatcctaagcactatgacaatgactatgacaataggtactttgtttgacttttttttttttgctgatcttctagtgcctaaaataaatagtgctttgcacatagtgagcactcaataaattattgttgaagtctatataggaggctatagataggatgttttgttttatttttcatctttgtatctgcccagaaacatacatatttaatgggttaattatggttacagtaaaacccagttgaatttttttaagcccagttgaataagtatattttaaacatgtattttttataataatttttcttatagctaaaacttttagttttttagctaacaataaaaacattcacagaattctttgctgggtttttaattcatggtttatttttatccttttttgattctgaagcatgccagattaacaatatgtctgaataattgaggctttatttatgtaaatgttatataataataactacattttaataacaaatgcttaggtggttattttataacattatttttctaaggttgcattatcctaaattatgtctttagtcgtagatataagcacaatgtattatgtaggcaatgatttaactattgtagagttcaattatttaaaagagtaaaattttacactatgagttctagaaaatacatgtttatacatagagccacagtttaccttttgctagtcctagtaaatgctaattattcaattctcttactcatcatcacgttttctattctctccgttttgtacaacttatatcactcccaccttcccaaaacattatctgggcagctttgaatggaaaacagtcatgaatgagcaatcaatggctattcactacaaaatggtggagaggtgactaagagtttattttagacaaattttatatcatatatttagtttcttcatgtcacctggcaatgccagctcctcctctgttctttttttcctatatagtgccttcctggtcatatccttttcgtaaaaccatttaagatgaataggtaatggccacatattaaatactagtgttatgaattagtagatcaacaaaatatgaaatattaaaatgtaaggattgcctatctgttgcaaatataaagttttttctcttgcaaaaattatttttaaaaaagcaaggcatagaggaagaaatcctttgctatatttttttcttcatgttctaccataaattgtaaagtctagctttttaaatttttaatattttttatcttcactactcaaatgaggttaatcaaataccactaacaatctccagtttaaggggatagacgtcactcttgtgagattcacagggtactcagcaatctgtctcagcatcatgccattatttagagggagaccaaataatttgtccattaaaaagctaaaaattggctgggcacagtggctcacacttataatcccagcactttgcgaggctgaggtaggaagatctcacttgagaccaggagttcaagaccagcctgggcaacatagtgagaacccaatctctccaaaaaaaaaaaaaaaattaaaacttagctgtgctactcaggagcccaggagattgaagctgcagtgagctgtgattgagccactgtgctccagcctaggcaacagaacaaaaccctctctcagaggcagaaaaaaaaacagctaaaagtttttgggaaaggaaaacgttaatagatataatttaactgataatataatgtttaaaataatgaattaagccatgttgtctcaaaacagtttttttcttttatcatatattgttttctttttatttcttaatttttttttttttttgagatggaatttcactcttgttgcccagactggagtgcaatggcgcaatcttggctcactgcaacctctgcctcccaggttcaagtgattcttctgcctcagcctcccgagtttggattacagacatgtgccaccacgcctggctaattatgtatttttagtagaaacgagatttctccacgttggtcaggctggtcttgaactcccaacctcaggtgatccacccgcctcagcctcccgaagtgctgggattacaggcatgagccactgcgcctggtctatttcttaaattttaattgaatcttttaatacctcaccttattcccaaaaggattttcagcaacttacaattaaaatacagctactaaaagccttaaaccattcacatgatataaaagacaaaagttcagtggtgagtggaaagcgaatgacaaagaaaaattaagaaaatccttcctgagaaaagttcagtgacttcatccgaagcctagttatgaatttcatagctgtcaagtccaagagagaaaataatgggttacataactttcatagtttgtaaagcaaaacaaacaaatggggaaaaaccaggtaagtcagcaagagaaatatatttttgcgtgatcctgcaccctggaagacatttgtcacaagtataattacataaaaggaatgaggctatgtaataaatgctgtattaaaaaaaagtaatttttttcatcagtacttaacaaaaacaaatatatcattgagagttaaagacaatttgtggggggtagtgcagctaacgactaaatatatgtttcaaacttgaaaacagtgtaaaaatagaatggcaagtgtagtgtaaaacttggggttaaaatttaagttaaggttcctagtgtcccaccttatttaaagcagattattatagggatttattggaaattaaactgagcaaagcttataatcatttttgactagaataatgtgaggaattcacattattaaagtcatctctcaagggcaatataatggaaaatataatatctatcatgagccaataaattaacaaaatttaagtttaaaggatttgaaaagtacagagatttggaaagaattacttacttaaccataatttgaccattcagaagctaccagcattaacttgctactgcattactcgtctttttttattttaacatagttgaaatttcctatacaaaccatttttatcaaattttcaattagcatttcggcataatcaggtatccatattactacaacatcttttaaaatattccatgtaatagtatattttgtaagtgacataatttccttaatcattccttggctgttggatatttatgtgttgttttttcatttttccctattgcagataaccctgtaatcaacatatatgaattatcttaatttagtctctgtatatgaaaaaaacacactgggattaacgctaatttcactgccctccgtttctgcccttcctacttcattctcaggacctttcttccttcccaaccttttccatcccatccccacagcatacacacagactcacatatgagatatgattgtaacttaaagagacagcatcagttttcagacatccacaaccaaagtgggtacttgcaactataaaactgttgtaaagttcttggcagatactctgtttatattaaacactaaatctaggttatggtcctgatctcttgtaaccctgtgaagacgtctctggagatatttgggaggagaggaagaacacatgtcaccccatatctgagccaaaaagctcctcatgaacagtcattcacagaggtctctgcttagccactgagacacttgcttgctctctgcaagtttcaccataaaggtcagaaactggaagcctacaagcagaaaactctcatagacggttttgtttgtccaataatatttttaaatgttttcagttagctaatatcagtttttaaatagatagttatatataaaacattgtatttatggcttctttgaggaagttggtagatgtagctacacatgttcctattctaatatggcaacagatgagagaagctgttgcacttggacatctggacacagtctacagtgacattgcctgaccgctggagacactggagtctgtaacccctgctgtataggttagggctccagaagtcaatatggggagaaaacgtttctcattgctctcaggaattcgccattccccatcagagcaggaatcaaactatatttattatcctaaataataatctcattattctgtttagctatatgaatacatcattgcaaatctctaatagactttagatgtattgactcacatcctaacactatcgctacagctccacaagatggccaaggtcatacacctcattctccctctctttccaacaccaaacaccagtgaaaatagaatcctatgcagaaaaaacattcactcccataaataaacttttattcatcctttacccctatttaagccaaaagattttttaaaaaattatttgaagaactcctgattttaaaaaaaaaactatagacactatcatttgcctttagttctcctcgttcttgctagttaaaagtgatttattcctcctttaaaggttttgattatactaaatactttatttttaagtggcagttgtagtatgaacattaagcctcatcacacactatcgtgtcaatccttagcagactgttctccattcattgcaaaatgaatgaaataagagcagattatttcattcattttgcaatgaatggagaacagtctgctttttttaaaaaaatacatgagctagtgtgtgtttccaaatgttgatgctctaccatcattttaaggttaaattaaaagcaaactttggagccttaatttaaagcattgcctaaattgcctacgtagcacatgatatgcttttgtactaaatgattttctcatagcttttcatttctttcttttcattaccctcctcttcctggtccctcactgtcatcatgccttaccacttccccttgattcagtggtcggttctgtgccagtgcaatgtctttgccaaggtctggagcttgactgtgatgaaaccaatttacgagctgttccatcggtttcttcaaatgtgactgcaatgtaagtagaaaagaattacttcatcctgacagctgggtagcacctgtaaaattgtattataattaagaccatgtgattattcataatatatttttattcaaagatgatgtcatttttcctgggtcaggtataataattactgatatttattttgcatttattaaatgctagaccccaccttaaattattctttatattaacccctcataataatcctgcaaggtatggagtgtcaccatattttatctaaacaaaaaaagtcatcaattgcatgtgctactaagaaaaaatggcttctaattaaactattacatagagctttcctattatatagaattttcacttgacatttattgaaagaactctgttagaatttattggacccaaattttaatataatctgatgtgtaagttaaaaaagaaaataaggtaaattggataagatattcctcccaaaacgtcatatttaaaatctgttctgaatcacattttgagtcatagatgttaatgttgttattttcttaaggaattcaaacttacatatgtaaaaaaattatcaccataagtggtttgttgatttctagtacccgtaatgttagtttccagtactaatttgaattcaatgaacttcagcaacacaaacatatacatttgactgaaacttttttaaaagaaattagtggaggacagctattttaatccaatatttttgctgagtttcttttttcatttagataccttagtgccttgtggctctcacttttgggtatatgaggacaaaataagagtaattcttgagtttatgcatattgacaagtgttaccgttttcaaaccaaaccacataatacagcaattgaaatacttggtatatgaggtaagagctacaactcagagttcctgtgcatagtggttccattgaattcacagatctgagaagtttacccaatttgtggtggccagggaatatgaactgaaaatatcagcagagttttccaaaagagggaacatttccacttgaactaaggaaaagaagagctcttcagcattctatcctcttcttgccttaccatggctctttctcatagcaattagtcctgctagaaaaaagtaataattccccaaaagaacctgaggtcctatggagcacttctctgatttaaattctaactggaaattctgagtataagaatttatgaatagtctgggcaacacagagagagcccatcactacaaaaaaaaataaaaattagccaggtatgatggcccacacctgtagtctcagctacttggaggctgaggcaaggggatcacttgagcctgggaggtcaaggctgcagtgagctatgatcaagccactgcactccagcctggatgacaaagtgagaccctgcctcaaaaaaaaaaaagaatttatgatttcattctattttcagagaaaaaaatcataatccttctccactgcttgtatcaaattactagaaaatccaaatcaaaggatattctgatgcagccaatttcatttttcattttcccacgagtaagatttgaatccattctttaacaattcaaccaacatttgtaaaataaagaacagagagagaaagctgggggaatggaggggaataaggcaatggctaactagagagggcatgccccacacaaaggttgaatcattgaattaattcccattcaattttaaaaattgtcatgatctagtatacacatacatacgtacataaagagatgtgggcagaaagctgtgacctaccagttttcaacccctggtataaacaaaaaaactgggaccaggtccttgtaaatgattgtctgcaagaaggcaagaaagaaggagtcagagatgactccaaggtttcccttctaagcaacagtatgatcggagaatgaggagacttggtggcagtaactgaggaagatggggactctgatgttagatgttttttccaatgtgagattaacaggtcactcagtggaaatcttcaacaggcatttggagatataggaataaagctcaggagtttatgtctacggtattttttattttttgttcaaaaaatagcattatcttgtgctttaggttgagccacttgattccagttgtccatttatacttttctctgcagaacactggcttagactcatacgtagtcccagtctgttcagttccatacagaaaaagaactctatgctttatagcacatacattaaaaagtaaacatcaaatttcattagtcagttctttccagactttgagttggaactattacagggaaatgtcagaagaggactgaaccatatgtaagtatcaaagaagctaatactccaagtaatgtttattgaagttgggatttttttaagacatttcgcataaatgctaatgaacaaaacaggcaaacatagatagatatgattatttttacttttttctagcttgataaacactgattttgactatttgagacttggctttaagatcctggaatttaatcactagaactatatgatctaatactaagaactttctttataaaaactagagctagctttgacaataatgattaaactaggccatttctctctcacacacatacaaacacaaaccctctttgactctgtgaacaatcaaagttggactgtcaaattttaaaatataaggatttgttatattatattttgggttgttctattcaatgagaataacagcatctacctctttctatcccaataggatattgtgaaatgtagagaatgttatttgtcaaaatattttatgtcatttagaaagaagtaacctataaatcctagacactattaataaaaacccaactttttaagtaacattacttagaggtctttcaatgagcctcactttcctctatagtaactctcctccttcaagtgcagttaacctcttcctcttgggttctctcgtagaacctcacttgtgtctcttttatgtatactaaacattcttgcttgtgctatagtgattcaggtcctgttatctacctgaaaaaggaaaatgccatggcctatatatcctccaaagttcctaatagagtctaataatccctaaataaatgttattgaaatgaatttataaataaatacaaaaaaaaaaagaagttggttgcctcattagccccgggctgttaagactgaagttattattcaaagaaaattctctatttatagataaagtataatttgtgcaaatagagtataaacttcttaaaggcaggtatccaacatgtgcaaatggcaggcattcaacacattttttgagataatgaatgaatgaatgaacaattttttttttttgagacagagtctcactctgtcgcccaggctagagcgcagtggcgcgatcttggctcactgcaacctctgtctcccaggttcaagcgattctcagaacacatttttaaggacacactaaactttcatctatatccttaaatcaaactcaggtttttttgtttgtttgttttttgtaaacagacagggtctcactgtgccccccaggctggagtgcagtggtgcaatcacagctcactgcagccttgacctctgaggctcaggtgatcctcctgccttagcctcccaagtagttgagactactggcatgcaccaccatgcccagctaatttttttaattgtttgtagagatggcggtgggggggcagtctcactatgttgccaagctggtcttgaactcctgggctcaagtgatcctcacaccttggtctcccaaagtactggaattataggtgtgatccactgcacccagccaaatccaaatatttaacaatttatcttgacacaatataaacatttaaacaggatataagcagaatttagaatctaagtcaagtcagaatcattagcagaaaagagctcctcaattagttaatatatacaaggaaataatatttggtgacagccagcaactgagagtagtttcaaaagggaattacttgttaatcagcctttggtattatttatgtaaaaagccattaagtgtctgatatgtgtagtctagaaaagtgatttttaactttttttctttcattattgtttcccttcccccagggagactttttagacttttttttttctatttgtcccctcctgtgaaattttaatactacagatatacggacaggcgcagtggctcacgcctgtaatcccagcactttcggaggccgaggcaggtggatcacaaggtcaggagttcgagaccagcctgaccaacatggtgaaaccccatctgtactcaaaatttaaaaattagccaagcgtggtggcgcacgcctgtaatcccagctactcaggaggctgaggcaggagaatcgcttgaacccaggaggcagaggttgcagtgagccgagatcatgtcactgcactcctgcctgggccacagagtaagactccatctcaataataataataataataataataataataataataatacagatatactatatatgttcttgtgtatatctgcattatacatttaaaaagtaagattttttttttcttaagaaccaattctcaccttcattgagagtgcatggacttctagactctagaacagtgtttctcaaattagattccaaaaatgtgttccaaagagtccaagaaagttttttttaagaaggattcatcaccaagtttaagcaacaccacttcaaaacctaaacattgttagtgcttattgtataaaactgtcttaacctgagttaagttaacctccagacaatgcggtctgttgctcacttataagtatccgctccgtggtactatataatgatagtactaataatatcatattattagataccatctaatccaaatccctcctttcactgttaaagagactgacttggagaggttgtgtgtgattcatgcaaggatccccagctacactggttttggtttttttattgtttcatttattttgcttttactacattacattgctgttctaaaacaaaaaattaaggacttgggacctttccagtacaaccaaaattatgtggatctggtctgtgtcaaactgcttattaaattgtgatacaaaagaaaatcttcctgtacaacttcttagaagttgaaatggaatcacttattgaataaagatgatccaattataggtaccaattgatgttttccttcataactaattttaaggtggtggaatgtgagcaatgaaatattgagaaatacaatatttaatttcttgagtgtttttaaacagaaaatactgtttttattgtcacttagaaactgagatgccttctaatgtttgttaaatacaaataggaaagaaaaacataactgaaaatcaattttttcaattttattttttaacattttttgtcagaattacagtcataaccaaaattttaaaaaaatgaatagctttaatagtgcaaaactaacagctagacctagttcaagtgatatgataaatatgagagagacattatgaagcaaaatgtttcctgaaagctagtactaaagtaaatagtttgtaattatccctattgttgtaatttaaaagtaaaggaaaaacaactttaagaatcaaaatttacatttatttcaggtcacttcagtggaacttaataagaaagcttcctcctgattgcttcaagaattatcatgatcttcagaagctgtaagaaaatacttaattcctggtattacaattaactagcatttttggccatgtctttttcttcctacttctgtgaacaccaacactattccgctgcttgtgtctaatccctattcagggaaatatttagctgttaactgaagacttccaggtaacacttattttttctgagtaattttagaaaccattctagaaaaacctcagacacatatttccaaaggaactggaacatgtgtgctgtgaatcctcctaccacaatcccccaaaacggagatacttagaagcttttatcctctgcgttattctagcatggaatacctcaatgctcatcttagagaaaaatgttacgctcttttgtcagattcacgatgaagaaagtgaagaattttcttccatgtgttttcaaattcattatccacctaaaatagcaagtcactgtgggttgaaacctctgagcatgttgtcttggagacttgattccattttcacatctgccttgtgagttgcgttttattttggccttgagtagtatctgacatgctagcttcccttcagaactctcaaaatccatactggcccacgggatgtttacctgttatttaggtctactttgtgactaaattatgttgtcatatggtgaattgctgggtttagatagtctgtacctaaatcacactaactaagaaatatctcaggattcattgtttcatttttataccaatatagattggttcttattttggttttacaatagggaaacctgataaattaatatatatctgtacatttttaaagataacagatggaaattgagtggaatcagaagaagaattaacccacttccttcagtgaaatgttctaaaaacccagatagtctgcagaagtatctatttcatatttgaaaatagaaattctaatgaaaataacttttcaaaatttcattctgaacatttatcagtcaaaagagaagaacttttcacaattaggcctgacaaaacttcaagagtacactgacttattctattttctgatttctggagactgaagaatttttctgtagcatcaccttgtgtccacttatttaaaggagctagactacaaatctaaatatcaaaattcaggtttatataatgcagtggcttagcatttttgcacaataaacattgaattaattctcttttttgaactaaccaccatactaatgtggatgaattaattcctgaatgaccaatttgttccatataacaaaatgatcaaaatagcctaattatttaaaaatttctaattggttattaaaagtctatacctttagacctccaggcaatgcagcctattccttagtagatcattataacactagaaataaacaaacaaatgcatgataaatgagaaccattcattacctactacatgattgggcccacagcatgtccggttcaggtgcataataatttttttttaagagacagggtctcactctgtcactcatgctggagtgcagtagtatgatcatagttcattgcaccctcaaactcctggacttaagtgatcctcccacctcagactcccaggtagctaggactacaggcatgtgccaccacacctggctccttttttttttttttttagagagataggatctcactatgttgccctgcctggctggtctgtttcaaatgatcctcctgccttggcctcccaaagctctgcaattatgggcataacccacttcacccagcctataataaattttataataacatttcacaatcaaagttaggttttcttgcatgttggagaaatagggtacttttcagtcaaaatttataatttaactgaatgttcgctcatattgatttctttcttattgctcctaaaagttataacaaattgcatataaactttcaggacactctaaagaacaatggtgacctgcactcagaacatgaaggcagccttgaaatccttactttatcattcccgcaatctggggcaagtacacatagaagtgcaaaactttgtgtgggtgcaatgatgcaatagcgtatactctggtacccatttcctttgacctccagttaactcaaggtcgtattttcagtattactttagttaactatgtaagcctgcattcttgtcttgacattccaatctaatttatattcttctagtcctgattatttttatgttttttttcttttgccacttttactccttataaatttcctccaaacagtctttggaacaaggtttggatgtcaaattaatgagatcaaaattgatttggttgacagatttgtgattaacatagaatatggtttgggacattaaaaacatcatacacttttaggttggctagcactgtgttgagcacttaacaagtttaaagaattataacaagacccgtattaaaagtctggcttctagacttctgatttatgagggctttactatgtgttaacattttatttctagaaaattcaaatagtaagctttggctgttattcattcatctttataactagaatttctaaatacaaaccagcctaattgtacataaatttaacagaaacatgaagtgacatgatatctggcttcactaaattattttgtaatgtttacctttttcaatttttaaaatgtttaatcgtcatcaaatacacataacataaaatgtggcatcttaaccatttttaagtctaccttcagaggcattaagcacattcatattgctatgctaccatcaccatcatccatccacagaattctttttgtcttgcaaaagtgaaactctgcttcatttttttttctttttaataatcattttcacaggtacctgcaaaacaataagattacatccatctccatctatgctttcagaggactgaatagccttactaaactgtaagtaccagtgtgaattaatttgcccattccatggtagtctgacagcctagactattccaatccagaccagcctccctgtccatgacagtaccaaggagccatgcaagtgatgctgaaggggcagtagagcaccgtggctaagagcataggattgtgagttagacaggcttcagtccaagtcctgattgccttacttactaggtgtgtgatcttgagcaatttgtattcctttcttttttttttttttttttttttttttttgagacagagtctctctgtcacccagactgcagtgcagtggcgcaatctcagctcactgcagcctccgccttccaggttcaagcaattctctgcctcagcctcccgaatagctccagcatccagcatgagccatagaccaagaccctgtctctgacaaagaaaaaaaaaaagcctgatgatgatatttgtgatgaagaagaaaaaacccaaagacttccccagttattcaattactctttcttcactaatcccacttttacaaatgcatgaaatactgtaaggttaaagaaataaagctttttgtggtaaaatatacataagctaaaattcaccatttaactgtttttaagtaaaccattcagtggcattaagtacattgacattgttatggaaccatcatcaccatccacctccaaaactttttcatcttccccaactgaaactccatatttgttgaataataattcctcatatctgtctctcccaatttccccctctccccagcccctggcaaccatcattctactttctgtatttattaattggctactttaagtacctcatataaggagaatcataaaatatgtagttttttgtgtctggtttatttcacttagcacaatgtctttaatgttcacgtgttgtagcatgtgtcagaatttccttttttagggctgaataatagtccattgtatttatgtaccacattttgtttaactgtttatctgtcagtggacatttgggttgtttccaccttttggctgttgtgaataatgttgccatcaacacagggatacaaatatctgtttgggtccccactttcactttcacttcttctgggtatataccaagaattggaattgctaaatcagatggtaattctttgatttttgagggactgtcatttgatttgattttgattttttaagggactgccatactattttccacagcaactgtaccattttactttccaactagtgttgcacaagagttccgatttctccacatcctcaccaacgtttgtgttctcgtttcatttgtttgttttgacaataactatcctaatgggtgtgaatggtatctcattgtgcttcttttaaaaaaaaaggctttctcaatgttccgttttattgagttctgccatgcagcattctagaagtaactggaaagaagtataaccaaaaatcacatgaatacataactccctgtatttccatttatgtccccttgttttccacctatactgttctgtatcctaacgcaagaaacccattccagtcagatttttggcttgtggtatcagagtttgggattgagtcgagaagagcacctagtaatttactagcaaaatggaagaagactgcaggagactcgaagccttaacagtaaccactttagccatgtcctctccccttctaccccatctctgctcttttatgtcttagcaaagtacccagaatcaatattggactcactcttcaggctcctgactgtcttctttccatatatctttgcaaaatttactaaacactatctgtttggtttaatgttcagtgaatgtggaggaagctcttgaaaggcagtacagaactggagagtaaacttaaaagtgtcctccctctcttttcatagcttttctatagtgctggagtgttgttgagtgttaaagatgccacatatttctagttaaataatcattagtcccagcactttgggaggctgaggtggaaggatcacgaggtcaggagatggagaccatcctggctaacacagtgaaaccctgtctctactaaaaatacaaaaaattagccgggcatggtggcacacgcctgtagtcccagctactcaggagggtgaggcaagagaatcgcttgaacctggggggcggaggttgcagtgagccgagatcgcgccactgcactccagcctgggcatcagagtgagactccatctcaaaaaatgataataataatcattagatacctgatgatttatggatctaaacaatgattagatccataagtattcattaaccctcacagagtgcacatattttagttagataccatgagggcatagaaagataactcaggctggctccctttaagtagttataccttagcgtttcaggtagagcactgagctatcactggggagaggcaggactcctgttctctagaagtttatgatctaagatgggaaaacaatgccaacatatataaaacattagagaaccattttttaaaagtacttaagttccaaacctgtgttgctgaaaccaaaattgctattatggttcactgaaaggagtgattatctcaggtccagagcagtaaaggatggctctgaaaaatgaagaggactgggcaaaacaggtgagcatagggagcaatagtggatcaaatgtcttttacctggagggtttttgtataagagaacaccctgaggttgtaagtcatttcttaccccttactgtgcccacctgggctccaggtttgcaaaggagggaaggaagaggctctatcatggggtgccattgctcactagccctgagcaaaagtcaaacccagcaagggagaacagattcctggcaggagaaattctacaggatgtttactcaagatatgaaagactgaagaagagagagaaatcagtgtgaatcttgtattagtggaagtgaaacttgaactcttacttgcatatgaatcataagcagaaagaaaaaggaaagagggaagaaactggagtaagaggcgtgagcagagacactgctataaaacataatatgtactgaatgtttatggcatgcattgcctctattaaaccataggaagtagatcctgatactatccccattttagagttggggaagctgaggcttacaggaattcactgcttgctcaaagtcactgttaataagtagaggagtcaggaatcaaactgttcgatagcagatttagtgcagtgaattgctacactagagagattgagacatgagtgaacatggcaagaagaggagatcaacacaatagaacaaagagttatttcactttgcagaggagtgggatgtaaagatgggtaaggcagagtcaaaccctttagcaagggatgcaatgcccttttgtccataacaggcccctgcctgcctcctaggtttatctcctgtctctccttatagccccttcatggtgaggccccattgaattacctggtgatttcttaacttgtcagactctcatacctcttgcttttgcataagctatttcctctgcctagaatagctcctgcctgttctttgctttgtgaattgcatgtcttcatccaagactcttctcaattgtgcctctgtttagtaaagccttctcctggctcctcattcctccacactctgcagtccctacccctagcaaagctgggtgctttctcctctgcaatggcagagcaaccatgcattatatacttccctctgcttccctgacattacaaagtaatctgttcacatgctgtggcctctccagactcaaagccccttaaagaaagggatggcatgcttagcacagtgccatggggtaagtattcaaaataggttaatgaatacatgaatagatgaatgaatagattgattaattaattatggggaaatttaaaactaggtatgataaggtaagtggtagcaattcttagagattcaaaggcagggaagtggcatgatgagaatgctatgtaaaaaatttaagatggatgattattgtttttacttttcttattgtaagacatcaaaaatatacaaatttattgtagttatttctccttttccaggtatctcagtcataacagaataaccttcctgaagccgggtgtttttgaagatcttcacagactagaatggctgtatgtttaatttatgtggcattttattgcactagtttttagattctagagatatataaatgaattaatttttttcttctggctgtcaggataattgaagataatcacctcagtcgaatttccccaccaacattttatggactaaattctcttattctcttgtaagtactaaactaaagcaaatatttcaatcaaaggcaaagacatgaataaaaattaatgcttaaatttaataccattaaatttggatttgttaaaaccccaaagaggccttttcaatgaaaaaccttttcttaatcatattctataaggctatttatagttccaacaattttaaaagattttctgtcttctagaatatcagcccataaaaactgaatacattctcactcatattttatcacaatattcttttttttttttttttgacatggagtctcactgtatcgcccaggctggagtgcagtggcgtgaccttggctcaccacaacccccgcctcctgggttcaagccattctcctggctcagcctcccaagtagctgggattacaggtgtgtgccatcacgcccagctaacttttgtattttgagtagagacggggtttcaccatgttggccaggctggtctggaactcctgacttcatgatccacccatcttggcctcccaaagtgctgggattaaggcgtgagccaccacgcccagcctttatcacaatattcttaagcacatcgttactgtctatacaggcagacctcagtgatattgtgggtgttgttccagaccactgtaataaagcaaatgtcacaataaagcaagtcacacaaatttttttggtttcccagtgcacataataaagttatgtttacactatactatattcaattaagtgtgcaataacattatgtttaaaaatgtgcataccttaattttaaaactctttattgctaaaaagagctaacaatcatctgagttttcagcgagtcataatctttttgctggtgaagggtctcatgtcaatgttgacagctgctgactaaccacagtagtggttgctgaagcctggggtggctgtggcaatttcttaaaataagataacaatgaggtttgctacattgattgacttttaatttcatgaaagatttctctatggtatgcaatgctatttgctagcattttacccacaagagaatttctttcaaaattgaagtcaatactctcaaatcctcccaatgctttatcaaataagtttatgtaatattctaaatactttgttgtcatttcaacagtgtttacagcatctttaccaggagtagattccatctcaagaagccactttctttgttcatccataagaagcaactcctcatctgttcaagttttatcatgagattgcagcaattcagtcacctcttcaggctccacttctaattctagttctcttgctatttctacttcttctacagttacttcttccactgaagtcttgaacccttcaaagtcacccatgagggttggagtcaacttcttccaaactcctgttaatgtgaatattttgaccttgttttcatgaatcacaaatgttcttaatggcatctagaatggtgaatgctttctagaaggtttttaattgactttgcccaaatcgtcagaggaatcactatctgtggcatcagtagccttacaaaatgtacatcttaaataataagacttgaaagttaaaattagcttttgatccatgggctgtagaatggatgtcgtgttagcaggcatgaaaacaacatgaatctccttgtagatctccactggatctcttgggtgaccaggtgcattgccagtgagcagtgtatcttgaaaggaaatcttttttttctgagcagtaggtcccaagagtgggcttaaaatgtttagtaaaccatgctgtaaacagatgtgctgtcacccaggctttgttgttccattgatggagcacaggcagagtagatttagcgtaattcttgagggccctaggatttttggaacagtaaatgagcgttgacttccacttaaagtcaccagctgcatttgcctccaacaagacagtcagcttgtcctttgaagctttgaagccaggtattgacttctcctctctagctatgaaagtcttgtatggaatattttttcaatagaaggttgtttcatctacattgaaaatctgttgtttagtggaaccaccttcatgaatgatcttagctagatcttctggataacttgccgcagcttctctattagtacttcctgcttcactttgtaattttctgttatagagacagcttctttcctttccttatgaatcaacatctgctagctttaaacttttattctgcagctccttcacctctctcagccttcatagaatgaagcagagttaggccttgctctggattaggctttggcttaaaggaatgatgtggctggtttaatcttctatccagaccactaaaactttttccatcagcaataaggctgtcttactttcctatcatttgtgtgttcattggagtagcacttctaatttccttcaagaattgtccttagcattcacaattcggctaactggtgcatgaggcctggttttttgacttatctcagctttcaaaatgccttccttactatgtttaatcatttctagcttttgatttaaggtgaggaggtatgcgagcagtatatcttgaaagaaaacctttttttttctgagaagtaggtctcaagagtgggtttaaaatatttagttaaccatgctgtaaacagatgtgctgtcattcagactttgttgttccattgtagagcacaggcagagtagatttaacataattcttgagggcccataattcttgtgggactcttcctttcatttgaacacttagaagccattgtaaggtcattaattggcttaatttcaatattgttgtgtttcagggaataaaaaggcctgaggagagagatatgggggaatggctggttggtggagtagtcagaacacacacaacatttattgattaagatagctgtcttggctgggtggggtggctcatgcctgtaatcctagcactttgggatgccaaggcgggcagatcatctgaggtcaggagttcaagaccagcctgaccaacatgctgaaactccatctctactaaaaatagaaaattagctgggtgtggtggcacatgcctatatccccaggtacttgggaagctgaggcaggagaatcgcttgaacctgggaggtggaggttgcagtgagccgagattgcaccattgcactccagcctgggcaacaagagtgaaactttgtctcaaaaaaaaaaaaagattgctgtcttctatgggcatggtttgtgacaccacaaaactactgcgatagtaacatcaaagatcactgatcacagatcaccacaaacaatataataataaaaagtttgatggctgggcagggtggctcacgtctgtaatctcatgctttgggagattgaggagagaggatagcttgcagccaggagtttgagaccagcctgggcaatatagcaagaccccatctctaccaaaaaaaaaaattgtttttagttagcagagcatggcgacacatgcctgtagtcccagctactcagggggctgagacaggagaatcacctgagctcaggagtttgaggctgcagtgcaccatggtcgcaccactgcacttcagcctggacaacaaggcaagaccctgactcaaaaaaaggaaaaagtttgaaatactctgagaattaccaaaatatgacacagacacactaagtgggcacatgctattggagaaatggcattcatagacttgctcaatgcaaggttgccacaaaccttcaattttaaaaaatgcactatctgcaaagtgcaataaagcaaaacacaataaaacaaggtgggccaggtgcagtggctcacacctgtaatcacagcactttgggaggccgaggtgggcagatcacctgaggtcaggagttcaagactagcctggccaacatggtgaaaccccatctccactaaaaatataaaaagaaaaaaatagccgggcatcgtggcaggcgtctgtaatcccagctactcaggaggctgaggcaggagaattgcttgaacctgggaagcagaggttgcagtgagccaagattgcaccactgcactccagcctgggcagacagagcaagactctgtctcaaacgaaataaataaataaataaataaaaataaaacaaggtgtgcctacattaatcttggtaaagaaaaaaaatgcctttaaatcatctcctttccaccatttgttgttgacgggtttaggctatttttttttttttttttttagttactaacattactgctttcctccatataataacttatatttgttaaaattttattactatcaagtatttacatataattagattataattaaatatagttagattataattaaattataatttaaataaaattagagggaaggctgggcatggtggctcacgcctgcaatcccagcactttgggagtccgaggtgggtggatcatttgaggtcaagagtttgagaccagcctggctaacatggtgaaaccccgcctctactaaaaatacaaaaattagctgggtatggtggcacatgcctgtaaccccagctgctcggagggccgaggcaggaaaatcacttgaacctgggaggcagaggtttccatgagctgagatcgtgtcacaccactccagcctgagtgcctccatctcaaaaaaaaaaaaaaaattagaaggaaaaaacaactaatttagtggatttgtgggtttcataagaataataataataccatgtttgacccaagatgagaagagaaccagaaaaatgtgacttgtttgtcttttcctttttcagagtcctgatgaataacgtcctcacccgtttacctgataaacctctctgtcaacacatgccaagactacattggctgtaagcgattctgtctttttttaaagaactcaactaaattttctgtttttacctaattcattccagatataagattgttttagtttttcttaaaaatgataagggttttagtatcatatcacatttcctcaaactgctttaacatgatttttatgttaaacatctacattatctaaactaacatctctaaactctcagcaaaataaaacatctcaaaaaaaatatatatatatatatatatactggagccaggaagaagaaacacagaaggaatgtcaccacatctatgtaacatctccccctttccctgctggtatactcacctactaatttggtacagaaagactaagttgttttaatttcactctagaattctgaataataagaatatgatatttagcatttatttttcaaaaactaatcatgataaaatatgttccatggaatattttacaaagtagctttgcttgtagtaataagtatcactccaccatttagaactcaaccatccagtaaatttgcctatttagaacacaagtgaaaaataaaagaaagaaataaccaaaataactactaacaagttcaatcaacaaactgccatatgctgtatcatatgaaaactccctctgtctcttattttataagaaattctcagaagttggttgtttgatttctaagctcatagcagattacaaatgtcaaattaaaaggaagaggaaaagttagagtcagaagcattgattgtagtcagaagtaacaactatcaacttgataaaaaagcataagtgagaaatgctataaaaagcaatgacagtaattcaaactgtactaatctgcaacctctcagaaaaaaacaaacattctgaaaagttactaagtccagtaggcattttggtatgacagtataatactgtactgtacattgaaaacaagctaaagccataaaggaaagggcaaattaagttcaacatccctcattaaaattgaattttggttcaaatgaatacattagcatctattacagcctctgtaatcccaacttagtaattaaacacaattgaacaatatttacataattagcaattaaaatgtgtgcatttagacagaagcaactgtgtgcagtattatgcacaagcaataataaaccttgcctttgtttacaaaaaggcaagaaaatatacaatatacttcagataaacatcaaaatgattaagatgtattactaaaaaaattaaaattaaaaatataaaattaaaaattttgttactaaagttttcatatgtaaattctagctatccaaaacaacttattccatatgaattcctgatagtgaatattatcctgattttaattctagtaataataatactttgctttataattatttacctttttataactaatgatactattcttaccttgcatgaactttcatttagcacagtatgaactagaaaatctgacagatttcttggccaaacatcattttaactctgatttaggggaaaaatacatacaaactaaagagacagatgacagcccaggaaattatgcttctaaggtatttgcaggacaataaactgaaacctatattagttcttgcaaagcaatgagaaactgtaaatgccacaataaaagttgtaaaattcaaaaaaaaagaaatataagtaataagcaagcataaggacagatatggcaatagccaaaggtgaactaaaagtcaagaataaagtaaacttttcttttgagatgaaattaagcaagtttatttattagccaaagaagtcaatatgaaaagcttgaaaatatagaagacgatgggaatacataatagtgcaaagtactagaagacatggaaaagaatggaaaagtaaaatgtgatcacacacacacacacacacgcatacacacagcagtgaaaatgaatgaattatcaatacttcaatcaacatgactcaatttcaagcacatatgaattactcaagaaaaagtcacagaagactacatatattacatttccattcctataatactgattaagatatagaaagccacaagacagcagtacttcctctctacctataagaaagagctttgtaatctacaaagtcataattttgtggagcccatcagtaggctacagtcataaggtagccaaataaatggaattctaacaagcaacaagaagatgtgggacatacatactatttcacctttggcagagcacaggatgaagagttggctggcgtgaaagcaggtacaaagaaaactaaaactttaataaacttgtaagcttaagtgtgggctactatagtgctttaaaagaactgggaaccccatatgcaaggggatttagctatctttaacaggctctttttcactgatctccaccaaccacaagaaaaactaggagtaggtaaggaaaccagacagagccctcattggtagcacaacacaaaactccaccttcttctctaaactcacccgtctcagggaacaaaagcatcaagcctttgggagtgggacagaaaatcctcctgcacccagggaccaggcaaaggtccattacttccataggaggaatagaaactagagcattctgccccagggtaccaacaaaaaaaaaaaccactccagcccaggatcttgcactgatcaaagcagtgggtagtgcccatttgtatcacggcaggaaatgctcttatgagagtttggcttctggagaagggggaacagcaaagctgagacagccccatccccaaaagcataaggaaaaagaagttcatgtcaaattataaagcaatcaacagaaccagaaccagcaataactcagattttacaacttccaaacagagacattaaaatgcttatgattaataagttaagtaatatagtggaaagatggataatatgcacgaacataaagaaaatgtcagcaaaaagatggaaactacaaaagagaaacaaaaaattatttcaacagccttagcagcagaatgaacacagctaaggaaagaatcaacaaccttgaagatatgtcatagaaagctttcaaattgaaacgaaagaaaaagagacaaaaataaaggcaaaacagaatccaaaagctgcaggataatacaattgtctaacaaatgtgtaaatggagtcacagaaaaagaatagaggaagaacaggacagaagacaagctggagaaataatagccaagaattttgttacattaatataatgcaacaaaccagaaatctaagaacctcagaaaaatccatgcagaagtcaagaaaaactagataaattatagtcaaactgctgaaaaccaaagataaagaaaagtatcttaaggcaatcagagaaaacagaaacattatacactgtaaaacaaagacaagaaaaacaacttttttttaaaagccagaaggactatggtaatattggcgaaaaagatttcagaacaaggactatcaccagggataaagagcgatatcatataataataaaaagatcaattaagcaaaaatatgtgataatcttaaatgagtaaacagtttcaaaatacataaagtgaaaacaatagaactgtaaagagaaatagctaaaagtcaaaggatgtcatttaaagctgatgaatctttggccgggcatggtggctcacacctataatcccaacactttgggaggccgaggcaggaggatcccttgagctcaggagtttgagaccagcctgggcaacatagtgagactctgtctctattaaaattttttttaaaaaattagctgagcgtttagctgggcgtggtggtgggcacttgtaatcccagctactcgggaggctgaggcaggagaatcacttgaatcctggaggtggaagttgcagtgagctgagatcacaccattgcactcccgcctgggcgacagtgagactctgtctcaaaaaaaaaataaaaaataaaaattacctgagcatggtagcatgcacctgtaggcagtcccagctactcaggaggctgaagtgggaggatagcgtgagcctgagagatcaaggcttaaatgagctatgattgtgccactacactccagcctgggcaacagagggagacttgtctctggaaaaaacaacaacaacggacaaatccatagattagatagacagtggtattcccaaggtgaacactaataaaaagcatgtaattaaccaatattgtatggtaaagagaggcagaggagcagagaggaagacaatgtacacaaattttatcatttcttagtatcatcaaaagaaagaaggtatagtgcattgagtaaagttacaaagattgccaatagaatatacaaagctttgtaaatatcataagaaataaattttttaaaacaccattaggttaagataaatattagacacaaaaaaaacctgaggtgaaagttttttaaacctatggaatcgtgtaataatatttttaaaaaacagactaaggccaactatattaatcatatcaataaatataagtaggctaaactcacctattaaaaggaaaaagactgggaaagaagacctgggaagatatttctcaaaaaatacttaaaaatggccaacaggcatatgcaaaaatgttcaacattactaatcatcagagaaatgcaaatcaaaaccacaatgaggtatcacctcacacctgttagaatctctattatcaaaaagacaagagatgacgagtgttgacaaggttgtggctagaaaggaattcttgtgcactgtggatgagaatgtaaattagtacagctattatggaaaacatatggagcttcctctaaaaattaaaaataggaccaggtgcggtggcttacgcctgtaatcccaacactgtgggtggcagaggtgggtggatcacttgaggtcaggagttcgaggccagcctggccaacatgatgaaaccccatctctactaaaaatacgaaaattagccgggcatggtggcaggcacctgtaatcccagctacacaagaagctgaggcaggagagtcacttgaacccgggaggcggaggttgcagtgagccaagatcacacccctgcactccagcctgggcgacagagcaagactccatctcaaataaaaaaaaaaattaaaaatagaactaccatatgatccagcagtcccacttctgggtatatatccaaaggaaattccattagtatgtcaaagagatatcttcactccaatgttcattgcagcattagtcacaatagccaagatattagtcaaccttagtgtccaatgacagttgaatggataaagaaaatgtggtagatatatacaatggaatactagtcagccttaaaacagagatcctgccattttgacaatatgtgtgaacttaggggacattatgctgagtgaaataagccagagacagaaagaaaaatactgcgtaatctcatttatacgtggaatttctttttaagttgaacacatagaaacagagtagaatcgtggctatgggtcatggcagggggaatgaggagatgtaggttcaagggtacaaaattacagttatgagatgaataagcatacagatctaatgtatggcatgtctatagtttaataacactgtattgtatagtggaaatttgctaaaagggtagagttcaggcactcttaccataaaagaaattaactatgtaaggtgatgggtatgttaatttgcttggttgtagtaatcagtttactatgtactgtatatcgaaacaggctatataccttaagtatacacagtttttaaaagtatgtcatgtaattgcaaacaaaagaaagcaggcatcatatattttatctaagtaggtggaattctggccaatgtgcattaaacaacacaatgacattttaatgctataactgccaatgtccaataaaagatatcacattataagtctatacacaccaaagaaattaatatagcaaccaaaacaaaagaaaatgtagacatacataagcagtaagaaataatccaccactgggtcaggtgcggtggtgcatgcctgtaatcccagtactttgggaggcccaggcgggtggatcacctgaggtcaggagtttgagactagcctgactaacacggtgaaaccctgtctctactaaatacaaaaaaaaaaaaaaaaattagccaagcatggtgcctgtaatcccagcaaatcaggaggctgaggcaggagaatcacttgaatccaggaagcagaagttgcagtgagccgagattgtgccattgcactccagcctgggcaacaagagtgaaactccatctcaaaaaaaaaaaaaaaaaaaaaaaagataatccactacttctcactccataaaagatcaagtagaaccaaaataaataaataacataattagtaagttaatgctaatcagtgtatatcaaacttcagtgccccttctcaataacagaactgctttctttgggacagcaacataactagctaaaatactacattcccacacttctctgcattcacatataggatatgtcttaagttctgactagggaggtcgaagtattacagtgtagaacttcaggaaaatctccttaaagagaaagatgcaagtcctttcttttccttctttatccagaaaacaaaaaactgaatatgatggcttgagctttagcaacatcttgtaccatgaagacaagggcatgtgatcagtgaatatgaaagatcctgggtttctaacaactttgtaaaacaaccatatcagccctgaactgcccaactctagatttttttttcctggggggaaaaaaccccaacaactctgcgtatttatgctattatagatgggtctctgttatatgtacgtgcacctaatcctaatagatatgaacttgaaagcaaagaatgcccaaagaacattcaccaaaattgaccatatattttaggacataaacatacacaaaccaaactcaagaaaacagatggagggattagcctaaaacaggagaagggtcatctcttcctctgagactagaaagagaccaggtgcatatacaggtaagtttacagatgtcaggcagcaagtcaagggcttttcccttcttcatcacctcagttttctctgtgaaataggagccagaaatgtaaaaggtagaggaggaagcagatagagagtaagattttcatgttttgaatgccactaagggacaagttgagggagaatagacaagattatagtctttgtcttttgttattgttgttattcagattgaagaaccaccaaagttttcatttttatccaattctaccaggtataaagggaaaaataaaatggttagtctcagaggctcattagataggaagggtggtggtttaaacacagtaaaaaatagaaataaaaataaaaaaaccttcgttaactccattaaagcttgcagctagggagcaagaaacagattttttgttgttattttgattttgttgttgtttttgcttcagctaagaggtatgctgcaaaccagatccctgcttatcaaggactaaaacccctaactttaggaagaaaatatacatattcatatgtatgctcatatacaggcccatagaaacacatcatacaaatgtgaccccaaatgtttttattattaacacaggaggggggaaaaacagtaaataaacaacccaaggttaaaataaattcaaaattaaactaccaatttaatcaaatgtcctaatttgtgccccaatatgtgcctctttttgattttcacaaattagtaaattagtactaacaaatatttttgccagcctaatagaaaacagttacgtaagtaactaaataggaacatcaactcacctcattaagcgcattttgtgagacttaagagagcatcaccacctggtggtagattcagggtaatgattagcaaccaaatagaaggaaatggccagtccctgtcacagataacatacattatgagagaccaaaagccttggccaaaactaagaccaaaaaaagtagcactataagtgattagcttccaacttaatagaataacagaaatttggaagggtgatctagaatccacatttaagattctaatacaatatcccatgtagtacaaaaatcctgtctacaaaactatagagatatgatacattgtctgtgctaaatacctgtagtaaaaagaaacaacttctctggatatcatagattgctagataggtttaagttgggtttaaatttgaaactttttatgtccctcgatcagtcaatctaattttgcaacccaatgcaacatagaaaacccctgatatattctatagcctgacttcaaatatatctctcattttgtttttgtttgttataaataacaccccatattcttcaattgccttgatttctagataccgtacatcctggtcttccagattttacagatatatttgatttgtcagcatctatttttaatgcagcacctaaaataaaactgactcacatgttggcagtggagtataggcacttctattaatactttccatgtttcctttcagattttaatagctgtatcacacttctgctcacatgttttagtgacaattattcctgaacagctttatgttacatggtgaccagtaagctgagtgttagaagaggctgaatagatttaagggccggcatttacttttgaaagtctatccctaaacctcagctctcttcctctgctctataaagttccaccatatactcacttatgaaagaagaggaacaataaaagagtaacttcaagataaccacgaagagacagtaaaacataaaaattttgatacatttttatgcttagaccataaggaggtttatggtgacataggcatcacacagcaagggagccccaggaggattatatttagatatctatatagatagatagatagatagatagatagatagatagatagatagatagatagatagatagatagatgtagagatagagatatatgcagctctctgaattggagatgcagaacctaaggcagtctgctgtttgctctctgtctgcgctggcctttgagacaatataaaaagcaaataagggtattcccaatagtaaaagattattgaggattttttctggggagtgattaggctggaaaggtaggagctaaatattgttttggcagcagcagcttttgcaacaataatagaatctgatgcagactgtagcaaaataaaatcacaccacttagggaaatgccatcggtaactttggacaaatgtttcatatggttcattatgaaatatcggttaataaattaggtgtttatcataacaaatgttttcaatttgacttcttgttcttttcaatttctcatatacatgcccgtatgcactcatgatacagatgggacgcaaaacatttttacctttaacatagaaaaaagtgtataatatagatatttatatatataatttcagctgtaatagaaatggctacaagtgagagtctatatgaaataaacagtatgtaaagaaaagatattttattagaaggcaaataattttaaccaatttatttctctccatgattaagatttagctgtatcgttttatttttatgttccagggaccttgaaggcaaccatatccataatttaagaaatttgacttttatttcctgcagtaatttaactgttttgtaagtaatatgctatgcttttgaagtaatattatcttttcttacaaataaaatttaaaaacacccattttatggaaaaaaaatcccaaagaacatcaagagtctgttgttggatctcagtttgagaaacactaaattgaagtcttagcctataagaatgtttatcctttgcaaattattatggtataaattaagtttttctttacaattgtgaaaaaatagttacaatcaaaatgaaaaacaaaatactgctgaatgttcacaaccttgaggatgtaattatggacatcaagataaaccttgaagtgttaatgagtgtaattccttcttatgcatctctggcctattttaaattcacatggtattttctgttaaaagtaaaggatgttaggtcttccttcagtaaaaaaaaatccaactctcctattcacagcttattttaccagaatgtttttcaaactatggattgcaactaataagtaggtgatgaaagtaatatatagcacaatttattatacccttgtcagcatttttaagggaaacagaatttaattgaatagattatatcagactgcaatgcagataataaatgtattgtttcatgagccttagggtgtgtgtgtgtgtgtgtgtgtgtgtgtgtgtgtgtgtgtgtgtgttttatgatccaatataaaacacattttttactgtgtgttaccacaggaatgatttgaaaaccattatcctagactacacaggacccctgtatataggcgatacaatagctcccactgatattaccatatgttttctccaattccccccattccaatgggttccaatgagttccagtttgaactcctcctgagttcagcaatcttcaggtacagggtgcttgatataaataatgcaaaatagtgtatagtaattgcccaaaggaaaccaaattgcacctgaaggacacagaacaaatagatatctgaaaaacttagaatttcttttctattgtacttgtatttattttttaaggaaacctctgtattaagagattatttgtggatttcctcttggcaggtgttgtgcttttaaggtccaagaatattgggaaatggtggtaatggtttggagtgcagtgaggaaataaatgggaaaggacaatttgaagacatgtcatacaatgtttaaaaaattaaaagccctttaaaacttagttctgagttggtcctctaggctagctggtaacacatgagatcagtgcagaaatgtcaagagttaaacagactgattcagcatcccaaattagagattcttctaaaggggttcagctaagagtggacttccttaggcagatccgcccgaaatcacatcaagtaacaaatgagtaggagtgctgtggtgggtgggctattttgttagacagtcatgctatgcagactgaaaagacaagtctaaaacagctcctatgctcttggttgcaagatatgcagtctgtattctcaaaagttggggttttcaccatttctcgtgcaaagctcttcctccctatttcacttaaaattttgaatttctattattatcatcatcaaaacatttgagaaatttaggattaaaattaaattggataatttatactacttcaaaatgtctttatgtgaaaaatgtactgtatattcattatctttgtttctgcataccgttcctctctttagtaattcttgtcggttacctaaagaagttacaatgtatttttctttttactttcagagtgatgaggaaaaacaaaattaatcacttaaatgaaaatacttttgcacctctccagaaactggatgaattgtaagtatgactgaacatatactgataagaattttctttctactgttttttcacacttgtacttacatgtgtttatacatttaagaaatattacttatctcctctttctaagcattatttacatatatacacctcaagccacaaaggaattcagatggcatacaaaaaatatggaaaataaaaatataaatatttgaggaaagtgggttaaaggaaacacagctgtaaagaaataataaagccagtataaaattaataaataaaatacattctacaccactctgttctactcctaaagaaggacggtaaatttatggggggttttttgttttgtttttgttttttgttttgtttgttttgagacagggtctcactctgtctcccaggctggagtgcagtggcatgacctcggctcactgcaacctccgcctcccaggttcaagcaaatatcctgcctcagcctcctgagtagctgggattacaggtgcatcccaccatgcccagctaatttttgtatttgtagtaaagatggggtttcaccatgctggccaggctagtaaatttgttattatgtttcctaaaggattaggattcagggaccataagattagaagataccactttgctgatttgaaaccaaaggataatcttgtatccataaggaaattagacactactgtggataatattcctacctataataatggaagagataaattatttttataatgcccctttttaatgccaatgacataattctaaagggcactataacaattctatgatgaaccaaagcccgtggtctaagtacattgtagttgattttcagaataaaatagatgtagaacaatggatgaagtgcttatccttcagaccatttttttatattttagtgtcaatttttttcttttcattttttgtttgctttttttctagtaccagggtgtcactctgttgcccaagctgaagtgcaatggtacaatcatagctcaccgtaacctcgaactccttggactcaagtgatcctcccacctcagcctcctgtgtagctacgactatagcacaccaccatgcccagccaatttttttttattttttgtagagacagggtctctgtgttgctggggctggcctagaactcctggccttaagcaatcctcccgcctcagcttcccatacttttggtattacagacttgagccactgtgcccaagtagtatccatcttctggaaagaatctgaatgtggacagagctacttgttttgacaattagctagacagaacactgatttattaaaacttttccataaaaattaaagaatacaattagaatgttatgaaaataacaccaggacaccttacttgggcactcaagaagttacaatgtgtttttccttatgctaggtagagggaatacatgtaccaggagcaggaacgtttctcaggtaacaatcctgcattctgccccaaaacatcagggaatgagccattaaaaacccaacattttatctgtagcctgaaacacttttggtggtcagtaccaatcattcacaaaatgtgcaggaaaatctcaaaaacaaatagacccaaccatctgttgtagcaactcctggcacgtgataattgaaccatatcatcagcacataggaaagtagtctaaatagtagggggagatgcagctggatgatccaaagtattatctagacattagaatacaagttagtcaaggaatactaactatatactttttcttgtttcatccacttgaaatcatacctgaatatcaagggacagttccttcaaatcctagccttcatggtggcagtcaggtgcagattttatatatcaataaccaacagtgaacatgaactcaaagggcttagtgcataaccaatgctaatccaggttcagaagtaaaggaaagaataatacaaactgcagagggtgaccaaggccaataatttgtcttgctaattattaggtggactttaatgcacctaatcccatattaaacacttacctgaaaaatcagattcaccaggacaaaaatagcatgttttctaagagtcgatggctttcattggatgagtctatatctaaagtgtccttttgagagagggttgaactacactctgtgcccctccaggctccatcacaccaacagagttaatgaggacaaagaggattcacttgtcacagaggactttaagtagctctagtgacagaaaatctttgccacgtgggtgacttaatttgagcttttaaagtcaactactctagtttacaaggtgtttcctgagttcattcagaaatggaccttgactccaattaagtttagcctaactttcctaaacttaagctgagaaaatggccctttcaaatgtcacttgggatctgggccaacactatcccattacatgattcatgctgttagaactatctgccaggatttgctctgataacaaaacccacactcccaccagtaattgttgaacaagacatttggaattttaatatcccagtgcaccattttaaatccatttgcacattgctttactaatatgatcaatattttacttggcttcctatacaaggaactgaaattgtgccccacttttactaaagatgaagcagatagactcagtgtattcatagtcttctaactggggatggagaaaacagctagtccaaaactgagctaggcactgggtagcccagatgaatagatatcgttcttgtactcaaagaactcacgtttcagaaaggaagcacatatgtacagaaacagttgtagtatgatgttatatgtgctatatgtgttatatgtgctatactagaagtgtgcaagaggaatgcataggagaacaaaggacaaaacacttaacctccctgggctcagaggttaaacagaggaatgacgtttgaatgaagtctagaaggatgaatatgagatcacaaggagggaaagaagagcatggggattaaaatactgaagtgcattcgggtcatggtgaaaagttactttggatagaaagtggtaggcaaggagactggaaacatagtcaatggcaagacatttgaatatttaaaggttcattatggccaggcgcagtggctcacatctgtaatcccagcactttgggaggctgagacgggatgatcacttgtgcccaggagttcaagaccagcctggggaacatgaagaaacccagtctctatcaaaaatacaaagattagctgggcatggtggcatatggctgtagtcccagctactcaggaggctgaggcgggagcatgcttaagcccgggaggtggaggttgcagtgagccgtttgtgccactgcactcacacaatgcggttttgatttcatctcctaaggtacagtaagctattgaaggagattccaactctttatgaaagagatggaatttttgagtaattccttcagttgtctaatcagaacaatctgttgacaattcaccgataaatatgtaactaacagcaatagtctccaggttcagtttgcagcaaagacgtttataatatttatcacattatattagccacttatttttagttttaaaaactcagtctaaaaattgtcctacccttcgaggtcaaaaaatctaacgtttgccttataagcaaaccagcatatataacaaatacatctattcattctcctacctatcccagtggcaacaaatatgatttggagatgaatagaagaaaaggttagactttcccttagtatctcttgatcaccttacagagctcaagtctattgaaactttttcttgtataaaagaatctgaggcctttcacatgagagctgccactgtcaaagctaccacgagaggtgctgctgtcaaacacctttttaggactaaggtacgaggtcataccatgttaagcagaccctctacacatacatgagatggcatgcaaagtatcctaccccaggataatatgagagcctgtgtatatcagctgtggaagaaactcgaacttgaaataatacacttccataataatcacaacaatcctaagcggaagaaaaaaattaagatcgcaaaccatgcatctattctaacacacaaaaaaagagaacaaaggaagaaggggcacaacacagaaatcaaaagaatgagaaaatgcgattgattaaaaccagatcaggccaggtgcagtggctcacgcctgtaatcccaggactttgggaggctgaggcgattggatcacaaggtcaggagttcgagaccaacctggccaacatagtgaaaccccgtctctactaaaaatacaaaaattagccaggcgtggtagcacacacctgtaatctcacctactggggaggctgaggcaggagaatcacttgaacccgggagacagaggttgtggtgtgccaaaatcgcaccactacactccagcctgggtgacagagtgatactcggtctcaaaaaaaaaagatcaaataccatcaagtatttgtcttccaggggatgatgaaatggaataaaatatttttatattttccaactttgctccttttttaaatttttagacttctggtgattaatataactcaccaatggcattgttgaaaagttgtatagtggtttcctaatgaatttcagaacaatgagtaaagtcttaagaaaataatatcacatatttgcaattatttctccagggatttaggaagtaataagattgaaaatcttccaccgcttatattcaaggacctgaaggagctgtcacaattgtaagactgatgttaattttgccacctcgtttctttattttattattttttaaattgtaaaatatgcataacataaaattagccatttttaagtgtgtagttgagtagcattagctacattcacattgctgcccaaccaccaccaccatctacctccagaagtttttcatgttgcaaaactgaaactctagccactaaacactaacttcccactcaccgtttccccatcccctggctaccaccattctactttgtgtctgtgtgaatttgactactccagatacctcatagaagtaaaatcatggaatatttatctttttgtgacaggcctattctacttagcatactgtcttcaagtttcatttctgttgtagcagaaatgaatttccttccttcttaaggctgaacaatatttcattgtgtatatgtattgcagtgtttattcacccatcaatggacattttagttgcttccatcttttgcctattgtggataatgttgctatgaacatgggcgtacaaatatctgttgactctgctttcaatttttaggtacctactctcaaaagtagaattgctgtttcatacatttctgtcattttatttttaatgcatgtttcattctgttttccataggagtttaaccattttacatttccgctagtagtatactagggtttccatttctccacatccttcccaacacttggtattttctgtttttttgataataggcatgctaatggatgtgaaatggtatctcactgtgattttgttttgtgattcccagtgattagtgatgttgagcaacttttcatgtgcttattggccatttggataccttcttgcagaaaaatctgttcaagtcattcactcatttttcaattggattgttcaggttttctgtagttgttagattgttggagttcttatatattctggatgttaacttcttttcagatacatgattttcaaatattttctcccattgtatgggctgccttttcactctattatggtgtcctttgatgcacaaaagtttttaatttatgtatagtctaatttttaaatttctttttttgttacttatgcttttggtgtcatatccaaaataacaccaaatgtcattggtgtcatgtcatgaagcttttcctgtatgatttcttctaagagtcttatagtttttagctttaatatttaggtcttaaatccattttgagttaacttatgtacatggtgtaaggtaaggatccaacttcattcttttgcatgtggatgtccagttttctcaacacaatttattgaaaagactactctttccccattgaatgtccttggcacccttgttgaaaatcatttgaccatatatctgtgagtttattcctgagctctctattctattccattagtctacatgtctgtatttcagccagtaccacactgattgctgtagctttgtagtatgttttgaaattaagtggtgtaaaatctccaattttgttctgcttttttcaagattgtttggctatgtgggctccctgcattttccatatgaattttaggatggattttcatatttctgcaaaaaaaaaaggcaatgggattttggcaggttgctttgaatctgtagctcactttgagcaatactgacatcttaatattaagtcttctgatctgtgaacatagcatgtctttcctttcattggtgtcttccttattttctttcagcaatgtttcgcagttgccagggtatttatctttcacctccttggttaagtttatttaagtatattattcttttgatgctattgtaaatggaattcttttcctcattttcttttgtgattattcattgcatatagaaacacagctgatttttgtgtgttaattttatatccaggaatgttgatgaatgttttagttcaaatggatttctttttagttaaatctttaggatattctacatataagattacatcacctgtaaacagagatcatttttttcttcttttacaatttggatgcctgcctttcacttttttttcttgccgaattgttctaattaggacttccaacattatgttgaatgaaagtggtaaaagcaggaatccttgtcttgttcccactcttaagggaaagcttttggtcttttaccattgagtgtgggttttcatatacatcctttattatgtgaggtagtttccttttatttttagtttgctgagtccacttcatttttttatacaacccattggtcattgtcattctttctctctttccttctttctgtaactgtggctcccccagcagttccttccatcccccatgtaacttatggtctaatcttcagtaaatatttttgtttatttcctctttttttttaattttgtttttgtagagatgggggcctcattatgttgcccaggctgctcatattggacttcaaggctcatgccattctctcacctcggcctcccaaaatgctgcgattacaggcatgagccaccacacccagtctaaatattttaaaaagagaaattttcctgagaagtttcctttaatcaatgattcttgtttcaaggtgttgtttttcaaagattctgaaattttctccatttaaatttacctttcagttctctttaagaaggcaggtgcttgtagtcccagtgagttgagaagctggggcaggaggatcccttgagcccaggagtttgagtacagcctgagcaacatagcaagtccccatctctaaaaaattaaaatataacaataaattccctttaaagtctacttttcatttcatgtttcatgacttaagatttattgtaaaatatatgatatattattccattaattcaaattttgactaaatgagattattttatttcattttgtttaaaccatatctgatcttaggcaaaatgtgaagtagatgcggctctttctcagtcccctaccacttctctggtggcagccctttcttgacagctccgccttcatgcctatgttttattaggtctcagtctatcactaccgtaatcacagagtatctaccacaagctgggcactgttctaagtgttttatcttaattaattcacttacatgtacaatcaaccctgtgaggccaatgctattgctatctctttatttcactgacaaacaaaaattgtatatatttatcagtacaacatgatgttttgaaatatgtatacattgtggaatgcctaaattgggctaattaacatatgcatcatctcacatacttattttttgtggtgagaacacttaacgtctactctcttagcaattttcaagaatacaatacattgttatttgctatagtcagcatgttacacaatagatgtcttgaacttattcctcttttctaagtgaaatttttgtaccttttgaccaatatattccaatcctttcccacctgcctctagtgaccaccttctactctctacttccatgagttcaacttttttagattccacatataaatgagatcatgtggtaattgtctttctatgcctgacttacttcatgtagcataatgtcctccagattcattcatgttgttgcaaatgacaggattttctgtgttttttaaggctgaatagtattctattgtgtatgtatacatatttttttatcaagtcatcctttgatggacacttgggttgaatccataccttggctattatgaataatgctgcaatgaatatgggagtacagaaatctctttaatatactgattttatttcctttggatatatatccagtagaggaatttctggatcatgtagtagttcaatttttgatttttgaggaagccccatactattttccataatggttgtactaatttatattcccatcaccagtatgcaaggggcaaccttttcttcaaatcatcctcaacccttatctttcatctttttgataaaaattattctaaaaggtgtgaggtaatattgtggtttcagtttgcatttctctgatgattagtgatgttgagcactttttcatatacctgttagtcatttatatgtcttcttttgaaaaatgtctattcaagccctttccctaatttttaaccagcttatttgttttcttgctgagttgtttgagttccttacacattttgggtattaaccacttaccagatatatgatttgcaaatattgtcccccattacacaggttgtctcctcactctgttgattgtttccttagctgtgcagaggctttttagttttatgtaatcccattcatctatttcacttttgttgcctatatttttggggcaatatccaaaaaaatcatcacccaggttaatgtcctggggctttccacctatgttttcttctagtcgttttataattttacagtttaagtctttcatccattacgagttattgtatactttcgttcataaatatgttaaagtaacccaaaataaacagattcactcgctttactcatgtagtttttagaaatgacctattgctgctttttttaaaaaacaggaatctttcctataatccaatccagaaaattcaagcaaaccaatttgattatcttgtcaaactcaagtctctgtaagtattcacatatggggatagttttatgataaaattgttttttaaatactaacaatgtatatttttatatatttacttcaaatcataagctttatttccaagacattagtttagctccacaaaaacatatgggtgcttgctgaactataaacagacaactattagttttatcttatatacttgtaaattaaaaaataatgatgaattattttatatttttctataagtcattaggagcttatgttgatttgtttgctttgacccttcaaagacatctgtgcatattcactctcttaacactgggtattttataatttattataagtgtttttaccccaagatggaatatgctagattatataaatccttacttgtaccacacacacacaaaaagacaaaaattctgttagagccaaagaattgccttaaaagataagcttcagggctgagtgcagtggttcacacctgtaaactcagcactttgggagtccgaagcaggaggattgcttgagatcaggagttgaagaacaacctgggcaacatagggagatgctgcctctacaaaaaaataaaaataagcaaattagttgagtgtggtggcatgcacctgtggtcctagctacttgggaggctgaggtgggaacattgcttgagttgggaggttgaggctgcagtaagccctgttcataccaccacaccagcctgggcaacagaggaagaccctgtctcaaaaaaaaaaaaaaaaggtaagcttcagttcatttaatttgagtgttccctcagtaaaatgacattttattagaaaaaaatttattaattaaaaattactaggaaattttcaaggatgtaaagcatcctctgctattgtaatattgtacaaaagataatgcttgtgcatttattccacacatatttattgattagttaaaatgcacaaagcattgtgccatgatctgtgaggatctgaaaaaaatcaaataaggaagataatacgtgtataaataacacaatcagaaggaggaggatttggggaagtgggtgggttgagtataattattttgttcagagtaagtgttaactaaaagcattttattaaattgtccttcacagaaactcaatttattaaaccatgtataatacatgttcctttgattgattattaatttgatatttttagcagcctagaagggattgaaatttcaaatatccaacaaaggatgtttagacctcttatgaatctctctcacatgtaagtagatattttattgtttttcactgtgatgttaatatttgtttccatgtgtattatgataatgcatccaatctattaatattttctactaatttgccagctataaactgaaagtttgtgttcctccaaaatgtatatattgaaatactaaccccaatgcaatggtacaaggaggtagggcctttgggaggtgactaggtcatgaggacagagccctcatgagtgggattagtgcccttagaaaacagactctggtccaggccagtggctcatgcctgtaatcccagcactttgggcggccgaggtgggtggatcacctgaggtcaagagttcaagaccagcctggccaacatggtgaaacctcgtctctactaaaaatacaaaaattagccagtcgtggtggtgattccagctactcaggaggctgaggcaggagaatcgcttgaaccctggaggtggaggttgcagtgagccaagatggtgccactgcactccagcctgggcgacagagtgagactccatctcaaaaagaaaaaaaaagaaaagaaaagagactctggagacgacccttgcccctccaccttgtgaagacagacagagaagatggccatctatgaaacatgtggtcccctaccagacactgaatctgctggcaccttgatcttggtcttcccagcctccagaactgtgagaaatgaacatttgtcgtctaagtcactcagtctatggtatttttgttacagcagccaagtggactgagacatgtctaaacaataattaaaactcttaaacctttgatattgggtgagatgattttagttttccacagtctggtagaatctcataggagattttttgaatctcaggaaacatgatgtgaggggaatccacttggtcttgtaagaagttctcctcagctctaataactgttcacagatattgatgtttgcctaatgagctagtaattggtgtatagggtgtgttagtccattttgcattactacaaaggaatatcggaggctcggtagtttataaggaagagtttattttggctcacagttctgtaagttgtaagagaagcatggtaccaacctctaattttggtgaggtcgtcaggaaagcttttaatcatggcagaggacaaagagggagtaggtgtgtcaaatggcgagagagaaagccagagagagaagaggaggtgccagctctttttaacaatcagatttcatgtgaaataatagaaggagaactcacttattactgcaggaaggacaccacaccattcatgagggatctaccccatgacccaaacacctcctactgggccccacctccaacattgggaatcaacttttgacatgagatttggagtagacaaatatccaaactatatcacatggtacaagtgctaccagatgaagaggaaggaatttatataggcaatataaaataattataaataaatcaatgctgcaaatgaaggtagttaagaagaagtctttctcaatgaaaatatccccatatatcaaggcatgattcaagcaagcgtgcatggatgaaatggtaaactttgaaacatcttttattcaaagagtatgtctagttgtacctgtgattacatgctttagaagcacttttttaattgaatgcaatttcatagcagttattagaatgatccatgccatggaaattaattttcaataatttagatactgtcagctaccatcaactctgtaatcttgcttgtattttaagtctaacacagaaccctgtttttgttttccatagttcctcagaaagatggcttataaaagattcctttcttgtatgcaacataaagcaatctgactaaattaaacagaacagaatttattggaagaaaatggtataacacagaatctgaggaataatttatagcctctggaattatccatccaagtgtcattcaatcagattcagtttcagggaagagaatctagttgatcacgtctagggtacttacctactctgggctagggattgcctccactgaaggtcccaccataacttctcaaaaagggagaagtaattctctcaaaggaaatcagaacactattatcagaagagtgattgagtgctgggcagccaaagcggcaaacagagttactataattctgttgataaaagcaaaacttcagcctaagacacatagtaaaataccaatcaacactccttctttcctcatgttctgctctcctgtccttcatggtttacagaataaatggatataaccgaatggggaaatatcagcaattgaccttgagcttgacaggacaaattgtaatcatcaggtttttatcttttcttattatagctctttatacactaaagatcgtttatattttttggcagaacacatggctttatagacaaatagatctaatttgaagttcaatttgcatatttagtagaaaatttcctagcaaataacttgcctccactgaagattcatctcttcctattaatgatgctaacacctacctcacggaattcatttgagaacttatttctgatacttaagaaatgctcaataaaaggtgttggtgttggtggtaacacaatagtaattataaattatccacatggtatatttatcaacaaggaaattctctctgttgatgaaagaagtcactcaacaaatatttattgaacgctttattatgtaccaaaatctagtgtgagagataggcatgttagcaagtagttacagataatataacttcttttttttttcttttactgtggcacttccacgtttaaaatctttaatattattttgttatttttattaattgacaaataataattgcacatcttcatgggggtacatagtgatgttttggtacatacaatgtatagtgatcagatcaggataaaggataattagcatatccatcctctcaaacatttatcatttctttatgtttagaatattcaatatcctccttctagctatttgaaaccatacattattgttaactatagacatcctaccatggtatagaatatgagaacttattcttctttctagttgtaactttgaattctttaataagtctgcctgtctcttccttctccttaccctccccagcctgtagtatcctctgttctacttttacttctgtaagatcgacatttttagcttccatatatgagaacatgaggtgtttaacattattcctggcttattccacttaatgtaatgtcctccatttcccacctagttgccacaatgacagaatttcattctttttttatagctgaatattccattgtgtatatctaccacatttttttatccattcatctgttcatcaacacctaggttgactccatatcttggctattgtgaatagtgctgaagtagcattgtttgtatggggtaattcctgaggtttgttgcctcacgccaaggaaattaaggacgtggacacacagggagtgaggttaagagcagaggtttaatacgggagagaaagagaaaagctctctctcctgcagagagagaggggctcctgaataggtcttccagttctgtggtgaaatgcacagggttttaatacagtagcttgaggaagccatgtttgatttacatagggcccaaaagattgcttggaccaggtgtgccatttgtatagcatgcgaagaagctggctgccccaccctaatctttcattatgcagatgggttctctacctgtttggcaccatgttgtctgcttctttattgtacatgtggttgacaaagaaaaggaaagatggagcctccatgttgaacatgcttggcccccaggtagccttttcctattggcacagctgccagcattcacctgtgcaagcttctagcttgcttttctatgtctgcagcttaatttttcaggctgctctttgttagaaaagaaattatttggggctgctttttattaaaagagaaagcttaccaaggactctcttaccctcactaactgcctaaatactttctttttagctcctgtatcagtgctgcaataaacatgggggtgcagatatctctttgatatgattttcttttctttgaatagattctcaggaatgggattcctggatcatatgctagtttttttttttttttttttggagacagagtctctctttgtcacccaggctggagtgcagtggtgcaatctcggctcactgcaacctctgcctccacaggttcaagcgattctcctgcctcagcctcccaagtagctgggactacaggtgtgcgccaccatgcctggctaattttttgtatttttagtagagacgggttttcaccgtgttaaccaggatggtctcaatctcctgactgcgtgatccacccacctcggcctcccaaagtgctgagataacaggcatgagccactgctcccagcccacatgctagttctatttgtagttttctgaggaacccccatattgttctccgttctccatagtgcctatactaatttacattcccgccaataacagttcccttttctccagattctcatcagcatttgttactttttggtctttttgataatagccatccatccaacgttggagtaagatgatacctcattgtggttttaatttgcatttccttgatcattagtgaggttgaacattttttcaagcataggttggccatttctatgtcttcttttttttttttttttttttggagacagagtctcgctctgtcgcccccaggctggagtgcagtggcacgatctgggctcactgcaagctccgcctcccaggttcacgccattctcctgcctcagcctcccgagtagctgggactacaggagcccgccaccacgcctggctaattttttgtatttttagtagagatggggttttaccatattagccaagatggtctcaatatcctgacctcgtgatccacccacctcggcctcccaaagtgctgggattacaggtgtgagccaccgcgcccagccttgtatgtcttcttttgagaaatatctgttcagatcatttgcctactttttaatgggatgttttcttttctttttttcttttctttttttttctttcattggtgttgaaataacatcataacttcaataacaaaaagccacggaagcacagaaaagaaaacacttaactcttcccctgagggatagaaagcagtcacttgcagcacaataggagctgtgtaactgcatttacgtatactaaccattgcgagtacgataacggtttctctggagggattcattctcttgatcacatctaacagtttgtattctaagacatgtctaacacttgttatgtttattatgcctatttgctactctcacccacacattctttaacaatgaaatcaagctaatgataattggatgtaagtttaaagtttcagaatccctaatgttttagtcctctcaatttcatcttaagacattttctttctaccgataaaatgtaggaaataaatatgaatgtatggtgacactgaattaaatggaaaatcttattttactttctctttgtacaccagatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgagtatttcctggttaaaggagaattgtagttttgaaatatacaaaagctttattattagaaaataagttgtgtgagtggtagaattatggaattttacatttttctcctttttgcttgtatgctgttttcacattttctacaaagaaaatagaattactttagcaataaaaaaatatgttttttaaactaggaaatttaatcaccttatgcaaattaaggaagctttcatttattagttctctctcatacagtggctccgaaggcacaatattttgttgacgcatctaaaatcttttactacaaataaaattgcaacctcctatggtcacaattttacatgcagacctatacttacttttttatgtgtatgtccagttcacagatattgacttaacaactacatgttttcctgatctctgagctactagaagttttttccactctaactgaaatgtgtaaataagaaaatatttttagggagtattcattttttcaaaaagtgtgcgcaatgtaatggcaaggtgttatgttaaatgaacactgcaaagaaaaataaggaagaaaccagtcctcaggatgtttgtagtctaggtcaagtgttctagaatttatccatgctccctcaagcaagtaaagcatcaatctacatgaggttctacttttgtatgtgtgctgcccccatgtgctgtccccatccttattcaaagtctaatgtctaaatgttttttttttattgcaagctatgtaagaaacagaactcagaagccatttactattttgtattgctagctacaaaatttttagtaagttcaatttccgtggtgaagcctagactgtaacttcagagttaaaggcttagggtcagccttgtgatttatacagtgatgtgattttagggattttgtgtagaatgcttgtgcgatccaaaaatctcacccactttctgatatgtaacgtttgcttaaaaagaaatatgccaagtagtgtaagagagctaattcctgggatcggagaccctaaaaagagacagaaaaagatgtaaaaattgaaagagagagaaaacagttttgcttagaccaactctggtaagtaatttaagccccttaaaattgtactgactgcaaagcagttcataattatacatatctcttaaattataggcttcagaattcagtcattattctatcataggaacttgtgaattactttctccaagattttatatgacaccttgagcttgttgcgttgggagaatttcagtggaagagcagaaccaagtaatgccatcctcatctgagtccctaactgaatgctctacgtgattgcattttgttcatttattcgacacttctatgtgatgggtctagaacaatagacaagatctgtgctgttagagacttgcactttaaaggaaaatgaagaaatgattgcataattaactgtagagagtaactttgagagtggttaccaaagagagtctatgaatagatcctcatctgtaaatgaattattaggagaataaaaattacctcttcctaa

SEQ ID NO: 118 - DNA, 131656 bp, Homo sapiens
gtgcgtgtgtgtaaagaaggagattaggacatttagagaaggagggcggggaggagagatcctgagaatagaaaggaggaaagaaaaaaagaggaatggaaagagacagagaaaggaaatgggagtggaaggagggaggactgctttgtaactgctaagattgcagacagaaatagcacacaaccactgtgagctgtatgcgattcagaaaccaagaccaaattttgctcactttcattaatcagttgctcagatagaaggaaatgacatctggttctgtcttcttctacatcttaatttttggaaaatattgtaagtatgctcagtatctaattttgtataccttagtattttgtggaataaccacaagcacaaatgtttactccttatatttatgcttttaagataaaatgcacttgctgataaaattgtaatctcacttcagaattgttcttcttagtatatgtctggtatttgtattaaagaccataatatcttatcatagtcaatagtgaagcgagactgatgtgccgtgtaaacctaggcttcataataaccaattcatataattgatattttaagcaacattataatatttaaagagtagtaattcttaaactgtattcaaggaatatattcattgaaaactcctaggaaagttctcacatttgtgccagtttctgtatagttgtaatgctctgtcgcccttattctttgtcatttgctatcataggtgtgcttctgggcagggagatgcattcataaaactctttttatttagcaaggtttatcactgttccttgaaagaaaaacaagggaaagcacaaagcaatgaaaaacataggcacaaaagaagctccaaatgggcatgttatttttactataatgacaaattttgttttctctgtgtgtgctatggtttatttttcagaaaatcttttttaaattcaagggaaacagttgttgtgtgttaagctccatttgaattatagtatgtagacagaaataaagtgtttttgtttcttaggtaataaatgatgaaaaagtcaaagccaaaccaagaacaaaactttctgggtatctttaatactttatgattccgggaatgtgggcttttactaatttagaaattaacaagcctttttatagtcctgtgtctcttaaaagtttgcataagttttgttaactctgagctcttctattaaggaatgtctcagggtaactttcaatcctgactctcccaattgtaatatgtcaaagtgattatatcttccttttcctccttctttcctccttccctctgctccatcgcatctaaagttaaaggacagcatcaaaaccacagaaactattcagaatcctggggaaatattctagtcctagccttctccatctctaatcttgattactgacagtcctattttttaactgaagggaaaacaataaattgcaaaccaccataaaaaatgtaatgtttctaattataattgcatgtttaaactaccagagcttttgacatttgtggccaacagcttcaaaaattaatgccatattttaccatccctattccatttcaatgaaatgaatagattaaataagccagaggaatatttccaaaatagtctttctagtatgaagaatttaagggtatataaaaggtgtttagggcaggttgggaagcaactttggccactgtgttaccagtcatttcaggttaggaaaaaaattccatgtttacctgtacccttttgttaataaattattttcatgagcagaaaataataatgatggtggtgatgatgatgccaaaaccctctgtctctttaaatttaacttctcttttgattcaaaagaaaatttgggagtgtagtgtaagttgagagctccaagttctcatccttccacgccttccccaggaaatgagggcataaacatttgcagcaaagtttggcaaggcaattcctcgctacatggtattaactgcatgttagggtgggggaacacttgtcagggacgccctgaaatagcacccacagccgtggctcaccttgagtttagcccctcacccaggccccacctaagtgagaatttcctgggcacatagcaatggaaatcaacagccacacataaggacaaattcttaaacctctgtaaatgccccatggttgttgtttctttgtgtgttttctttgttttgttttgtttttatatccactttcctgtaacgggaaaggcgatgtgatatcatggaagacacctaacctaagacgcttagctgcactaccatgtaccggttctgtggttttcagcaaatgatttacctcttctgagcatgtgaaatggcaatcaaatcctttaccctgtctacctttcagaaaccctgtgttccattctttattacaaaaattacttcctgaatcttcacaacaactctattatgtggatacaattaagcacacgaggtaggacattcagtgccttgtcacaagactccagctaataaatgccaagattggaatgctttcagagcccgtgctctctcccctagaccatgataattctcagtagccataatgtgtataaatgggctttgaaaactataaagcccgttacagacgtaagcaactattagtcatcctttcaaccaaaaatacctatgcatgccagagcagtgaccatgctttattcacctaccttgttaaagtaagcatggtccctgctctaaagggataggatggagaagacggcacgttgatctagaattcaattcaataagacaagtgcaaaaattgaggtccacacaaacagaggtgacattaagacttagaaaagatttccttttagccttgagaatttttcattctttaaaaatccttctgtccatagtctaattaattgtattgtgccaatgttaattttttagttttgtaatgtactaaatttatgtaagattaaggaaagctgggtgaaaggtgtatgggacctctctatactattttttcaacttcttgtaagtatatatttcaaaatccgtggttaaaaaacaatccccaggacaacttgtattataagttcttatcagaaaatgctgtattatttcttaaatgatatcactaagcaaaacaattcttttaatgttttagataggcaggaaacaagtgaagatataggaaatagaaggagttcaaacataagcttgatccactttagtattttgccaaggaccggcccagcttagtaaggtcttctctttcagactcctagagacacttaccaggctacctggcctttgctttggatcccagcactggcataacttgtaacagattttttctgtaactatgaagaagagaaaaggaagagacaattccagaacagaccattagcttggttagtacgtggaaaaagagaatgttcgcatatttatccaattccaaaagatgggagaataaacataccaatatgcagaccacagaggtatactgtgtcccaccttatactttggcgggggggggttgggttttttttttaatttgtataaatttatggggcatgagtgcaatttggtacatgcctagattgcatcgtggtcaagtcaggacttttagggtaacatgcgtggtaccaattaaataacttctcaccaccttatattgtggaggctgctgacaattttgtgttgtttttactacatattttgaatcatatttttaagtttcaaatggaaggaaaattaatgaatctgtgcaaatgcaccctgatctacataaagggaaattattatgtttatgaactaaatagtctttcaagtacaatttcacacattagtacaaacttgttaaactaaaatgcctggagttgagtattctagttaggtttaactttctgtctgaaaaactgtaagcatttagaccatttgatttcaatccttatatttatgggtgtagttgtttttctatttcccatttattgagaggtctccatggatgaggaacaatgtaagtgctttacaaacatgatcttattttattcctataataaccctatgagatattcttgctttacaaaataggaaacagagaatgagaaatatttggtagcattcctggcaccacttcttagtaatgttacaaaggagatttgaatccaagtctatctccttaaaaagcctatgctattaaacatgattcaattctaacactttcttaaattataatatagaatttaaagtgaccttaacagacccctgacctagctcactggccttcaagcaagttagatctttctctattttagatattaatccataaagaaatattagccagcccaaggtctcagagctggtaaatccagggcttccaccacctacggtgagggcctccccatccaaggcaagtttaacaaatccatgctaggcgtttatatatctcctctaatgagctggtgctatctgctttgtatacattcctcagtgtacaccaacaactgatgaattagtatatgtaaataatttgaatatatagaaagcacttttgtttgcagcacatgaaacttagctatacatacagcaagtgccaataaatattgacttaattcctacattagtttacctctccctcctcctggatattttattagccccacaaccccaacagctctatttcctgcctatgtgtagtgatcccatactctttcatctttttaaattctacagcttcatctatttctgtgatcagagcaacaaggacccaacactaaaccaaaagctctttccttctttggagataagcaggggcaagttgtgaatatttcaaatttaggttttgttctctatcacaacaaaaataaatgtcaaatggaaaaaggacagtgtaaagtgagatatcatgttgttcatgttagaacttggtattttcctactaaataactgtattttatagcaacctggatattattagatttgttgttaaatagattcattttataattatttcaatactacctaaattaactgggtctccttatttcttcaatattttatgataatgaatatgccttttggaaatcaatgttttcaaaaaatttctgagagttaatctttgggaacggtactcttgggacttttcaccagctggtctaggccacctggagcccttgcctctggccattgtgccagcaactctctccacctctctctccccatcattcttcctcaactcctcctcccatgttgctccaggaactcaagttctcattgagttcctatgcagatggacacagctctgtctccttagctcctgtttccaaatgcagtcctaggtctacatttagacagggtgctcagttgaaccaaaatgttacccacatgattagctacaaatgaaacagcagataatctgatacattctttaatagtaagattcacacttaaaaaaacaaaaagctgttgagattttaaataatttttttgttagaggattgagtatccacttgaactaagaggccatataattatatgagttattccattgattaaaacatatagttggccaggcatggtggctcacgcctgtaatcccagcactttgggaggccgaggcaggaggatcatttgaggtcaggagttcaagaccagcctggccaacatggcgaaaccccgtctctactaaaaatacagaagttagccgggcgtggtggtgggcgtctgtaatcccagctactcaggtggctgaggctggagaatcgcttgaacccaggaggcaaaggttgcaatcagccaagatcatgccactgcactccagactaggtgacaagagtgagactccatctcccccgctccaaaaaaaaaaaaatatatatatatatgtatatatatactgttgcctcctactaatcttttcccttggttctcatctaattcatttaaggaaaaatgaagtttctttttccacttcccacagtctgatcctcaagtaaattgctattacttagacagtttctacttaatgttgctcaagtactatttttaatttcagtttcataaaatcagacttttttgagttggaaggcaaggtaaagctataaaggacaacatcctcatttttcacatagaaagaaactaaggccatatagctgtgttccctttagttttcagctgtcttattcttaactcacttttaaaagtgggtctccaaatttcatatgtaggacaaaaagggcaagaaatatcaaaagggtaaaatatcacttgaaaatagaaagaacctagacagaaattgttaaaataaatttattatctaccaaaatcctagcatcaatgattaagactttgccaatacactaagctagtataatccctcttcacatacctaccttgtggaaaaacatttaaatcattctcacaaccaaggagagaaaggttctcattgcacctgtacatcaccatgtttgcagccaggcccagaggaattttaatgaaagggactttaaaaacgcttagagtaaggcggggggcagtgtctcatgcctataatcccagcactttgggaaaccaaggcaggtggattgcttgagcctaggagttcaagaccagcctgggggggcaacatggcgcgaccccccatctctacaaaaaatacaaaatttagccagtcgtggtggcaagtatctgtagttccagctactcgggaagctgaggtgggaggatcgcttgagcctgggaggcagagattgcagtgagccaagatggtgcactgcactccagcctaggcaacagagcaagaccctgtgtcagaaaaagaaaaaaaaagctcagagtaagtcaacaccaagtggatgtcttcactattaatatctcctctccagtccatgctcctatcctattccccagacaatagagtcatctctaaagatgcagcccttttcatcacatgccatgcaaatcatgaatctggcccttggggtcacccctctaaggtgagagaggcttcatgtgccacaggttgaaaaatgagacagcattgctacagcagaagaaactttgccaacttctcaggagtaatttatagactatcagaatctctcagacacttctagtgtccagagaaatcctctcttttttctgggtgccccagataatgtaggcaccaaatacctgtgtgcttcaccgctcctataacctcttctttcccaccaaaaaagaatgccatctgttctgtctttctgcctatgcaggtgccagagagggcggacagtggaggccctggtcgtagggagtcgaatatccctaaccttactgttttcttccctctccccaccccagcacacacagtttcctgagatagagtaacatgtttcaatcctcacctttgtggggattgaaaggacactcacagagcaacacagagcatcctcactgttatgttaaacgaccccaagatattcattcctgatatggtaaaacataaatcccacactggtcataaactctgctatcatgaaagtctgatctctttttttgcttgcttgttttttgttgttgttgttgttgttgttgttgtttatgagacagggttttgctctgtggcccaggctggagtgcagtggtgtgatcacagctcactgcagcctcaacctcctggactcaagtgatcctcccacctcagcctcctgagtagctggtaccacaggtgcatgccaccacgcccggctaatttttgtattttttgtagagatgggagtttcaccatgttgcccagactggtctcgaactcctgggctcaagccatccgcccacctcagcctctcaaatctctgggattacaggtgtgagccactgctcccaaactccttcaagttttgatcctgctacatgcttgggtttgtcctcctttgcttctttcccagattgtctatttagtgccaaatggactccctgcagctttccctttcctggctaagcaacctagatactggcttccagttctaattaagcagttcctctttctcccttagcgcttaatttctccttcctatcttaatgattctctgtattccttagtctcaccacaccttctgacaaaatacccacaaagagaaactctcctgtcttggtcccaaatcttgcaaccctaattctgatttctactcatttcatttccctaataaatacttcctcctcattaattaggactttcatagagaacagctgcctgttaaacatactacttgcagattacacccctccctcattttgcagttacctgggttcatggacatttttggccgatttttttcagtgttgtgtaaattagttccaacacctgatcctcataatacaagcaagttatgaccctgcagtttcctgtagttgcagccatttaaacagataaattttactttacagagtttaaattaaaacattataaaatagaacatgcaaatagataggaaatgacaaattttgaacaaaatttatatgcgtgtgtgcctggacctagtgaaagaaatcagataagctgccctaggaagcttttttggaagcttttatccaggcacatattgcaagtgtaagttaatgaaaataactcttctcaggtgcatcacgcattggcttctgagatacagcacaatccactctaccattaccttcactcataaaacctcagattctttttatcctcttctctcaccctctgttgctcaccctagccttttgatattttaatggttttttcccagagcaggctagaaatgtttgattcattttcaatggtccagaagatttgccgtttttactttctcagttgtggctgatttgctggaaattgcagaactgcctcatggtttataaatgtttctactttctcacacatttcaaacttagacagagtgacatcatcagtcatgctttctgttagcttcttaacctccatttaacctcccttttttgtgttaagatcaagagaggtggccagtttagcaaagtcaaatttagatttttatttctgcccttctaattgcagtcgttacccctgatcctgtgaacttgcagcacaacagtttaagttccctggaaaggaaagagggattgtttttctttgttgatattttctcaaccactgagcattcgtcttcagtggtgatccaaaataatgtggcaagtcatttgtctatcaaatccattttaatggaaaaaatctgtacaaagctttttgtagcgcatctggctcttgggcaccttttttcaaagtttctatgctagtaaacgttagcaggttcaatttgaaagctccacgccctcttctgttcttcaatcccctagaggctttgagtcttttttgagacagggtcttgctctcctggcccaggcttgagtgcagtgatgcaatcttggctcactgcaaactctgccccctggctcaagcaatcctcccaactaagcctcgcgagttgctgggactccaagtgcatgccaccatgcctacctatttaaaaaaaaatttatagagaggagaacacactacattgcccaggctggtcctaaacgcctgggctcaagccatctgcctacctcagcctcctgaagtactgggattgagccactgcacctggtctgcctttgactcttcactgtttctctctctttgatccaaggcccttggcctcactctctgcccctctgtttcctccaatcactcagcccctcactcctgatcctctcctgacacacatattcccctactgcacagggtcatcttgaacacaaaatttacttctattctaattttttcaggagaatccacccttcggtttttgtcctttttttcctcagaaagcacagggttgtggagggcttcagggaatgttgacaaaggtaatgccagcattctctgacatgaagtttgagggtggaaggaaatgttataaactactactacacacacacactttaaatcttatgccatcattaacattaagcataccaaatccaggtacgatatatagtgtaaacattttcatgtttacagaccagaaacctcatatgtgtaaaaattatattttatatttctatgactaaaattcagagctcatgactcctacataaaataatacaacatttaaatttgctaattcaaagtagcttggttttaaaatgaggcactttttctttaaaatgcaatctgggttttctgttggtttgggtattttgtttgtttgtttgtttgtttgtttgttttacatttagggggtatatgtgcaggtttgttacatgggtatatcgtgtgatgctgaggcttaggcttctaatgatcccgtcacccaagtaatgaacatactgcctgataggcagtttttcagaattttccccccctcctccccttttggaatccccagtgtctcttgtccccatccttttgtgcgtgtttacccatgcacccagtgttcagctcccacttataagtgagaacatgtagcgtttgtttttctgtctctgagtgaatttacttaggataatcgcctccagctgcatccctgttgctgcaaaggacaggatttcatttttttatggctgggtagtattccatggtaccatattttctttatcttatctaccattggtgggcatctagatggattccatgtctttgctattgtgaatagtgctgtgataaacatatatatgagtggaggtgtctttttggtagaactgtgtataaaatacaatctcaatcacttaagaaatcttacctgcgctacccttttccccttctccccttctgaccaacagcatgtgatttcggtgacagttttgcaaacatcaaaattgaggaggcaggtagagaggtgaacatctccagtcactttgccagctactcatgagggttaactcactctggcacggatgagtgacaccagcacccaccaaagcattcaaccacttttccacattgtcctccagctaatccacacacttctcaccaaagaccaccaccaccgtctgctcatagccttctcaggagagcacaggaagccctcaagtgtccttcctcacctattgggaactcaggcagattcggggctgacaaaggccctgtgtctagctcacccattcaccatcgcctccctcacttcaagaccctgcttctcctagagatgtgccctttctttgagctggacattaggatttgagacaagaatcacttctgcttaggcagtcccccaaattctcttagcagtttccaccttctcccttcccctacagagttttaataccaaagggacagggtgcttccttctcacatttcactctcagcaggttcaggaaaactgcttcgagggcatcacacatgcttaacccttaactctctagaggttgtggaaagactggatgttctgtgtccttcgttactggatcttaatgttcaagaccaatatggtagaatctaacaagtaaataaaaagaaagaaaaaatattatctctctcaagcacctgtcttttgccattgaaagccatgactctaaagctttggaatttaaagccaagaaggtgaggactcaggaaagtttttttgtgctctaccttccctgagcaataaagtacagtctaaatttctagttttagtggtggaagagtaaaaaaggaataaccatgaaggaagcataaatggacattaccctaaaatcagtaattataaacacaaagccacagtaattagaaataatcattataacgaaataccttagtaagagatgcactttttatttgcaaatcatatcatatcaaatttttagctatttcccaacactgtataatagacacaagtgaatatgcatatttacccttactctcaagaaacttctataggagaattggaattttcaaaacttgcctaatgatagatagggttagtctatcttcatttggtcgtttattttttaagtcacacacaaaaagtgtgcttatcctatttggattctaactcaaatatcttggctcaaaattctgtactctttctgataccaattttccctacttttctatttttctattctgttgcccacaatggttcctcatatttcacttacacctgcctttcatgtaacttttatttttaatctcttttccctacacttttctatatgctttttttcctattgctttaatcaacactaatcacaatattatagatgaaaacatcaatgtataaaaatattattcaaagcgtgaaaaatcccaaatcattaggcatatttattaaatttctcccacaaattctttctgatgcaatgtctaaaacaatagaatgtgtaataaataattggaaggagtaaggaatagtctcacatgacaatcttaccccctagaaactactcgatcacgttcttctctaattagtctcccagggacctacaccacttttaaatttattctggggaaattgtggcagatttttaatgtatattataatgtgctttattccatgtacttagatacacaaagtgttctagatcaatgttatgatattctgatttttttttttttttttttgagacagagtttcgctcttgttgcccaggctggagtgcaatggtgcaatctctgctcattgcaacctccacctcctgggttcaaatgattctgctgcctcagcctcccgagtaactgggattacaggcatgcaccaccacacccagctaattttgtatttttattagagacagggtttctccatgttggtcaggttggtctcgaactcctgacctcaggtgatccgcccgcctcggcctcccaaagtgctgggattacaggcatgagccaccgcgcccggccttattctgattattaataggaattatttacattgctaaagttataggtaagagtcattaaattgttgatgttttggttaaatgataagcactcataaatgttgtctgattatatcctcacatgaaccctgaaaggtaatgttttctcacctttccagaatgaagagagaaatttagaaatttgtcaatgtcacgggcacatcaatgcttagtccagaactcgaactcaagcttatctgattcccaagcctgagttttttcactcacatacaaacaccaaaatcatgtcctctctcatttttattattattattatatattattacctatattattacctataataagtaatttttattacatataataaaataatttatattgttatattaatatattacataaaaatattactattatagataatataaaattatttataattatataatattttatcatttattatatctcattttataaaacgagaattcctattcccattaacaggtgaacaagctagccaagcaagttgaactggttgcagatttaccctgttttatttcccagggagaggagagaagggcactgcaaggacaggtacagcatgcgcaaggtcatggagacaggaaaggacatggcaggctcagaacatgatgagaagtctggggtagtttaagaggagggctgaagcagatgcttggagatgaagttagagaggatcaccagaaccagatcatgaaggtctttgtaagccatgtgccagagttaggatggtaatatattagtaattcaaatcgaggttttgtacaaaatggaagtaacccaggcaaattaccaaaaatggactaaaatgtgagaaactgaaagcaatccttagagagggcgtggccattgcacttgagtcactggaaagatacaggctatgatcaagtcgaatcagctactggttttcacaaggaagtaactcaggcaaattaccaaaaatggactaaaatgtgagaaactgaaagcaatccttagagagggcatggccattgcacttgagtcactggaaagatacaggctatgaccaagtcaaattagagactggttttcacattgttttcctgggaccttaatacatttttaaaatattttctccctattcctatctataaaatacacaaaatatgtgtggaacacactacagaatgtttgttgaataccctgactgtgataggaccggcctttttgatattgcactccataaatatccaactattatctctatttctcattcttaagagtttgatctagtctgcgttgtgttttccacacttcctatttcccttgtgttattttccaactcactattttctttaactctggaaagccctctgatccagtttacaaataaggcaataaataaaacataacagaaaacattaacaaagtctcatactataatggacaatagatggacaaagtgcttatacacggttatttgaatcaaatggaatgaacccattatctggaagtacatacaatctgtactctttaatcaatcagtaactttgcaacacaaaggttgttactcagaaagtatcaatcaacagatttaagagattttattcagcaactataacctcacagcagtagaaaacagcacatagacaaataatttaaaatattgtgtttataggaccgaggcctaatacctgtaagaatataattttactctctctattttaatatatttacattttaatcaatagtactacccatgatatgtttaatgcatgggtgtaaattcattactttttctcatttgtattttcctttataaatgacaccttaagagtatgatgaaacagtgctgaaagtttaaggtgtattatgggaaatgcgtcaatcagagataacttcaatatccttagcagacttttaatttccctaagaattgcagaaccatagtcatgctatctagagaaatagcttgctcagaacatctttaaaataagaatacattcaatcattcttgcaggtaattattaacccaagtattgaactgtaagagatacctgacttaaaataggctctttttgcaaatactgtatacagtatgagcaaatcattgctaatgccttctaacatgactagaaatattataaatacaggtcatggaaaattatagttttaatacacatatgaaaagattagtggtttgccttcaactgaacaaagtcatattcttccactggataaattattttctggcataaattagatgcatatttggaaactcatattaactgtttcaaaataacatagccaggaaatcatatacactttggagttgcaatattgttgtactagatagcgtttacacttatgagctgaaagaattccatactcatggaatgcacaaagttttgtttactgtttccaaaaaaagtgacttctatgccaatttgtcaatttatattaggtttggtgcaaaagtaattgcggtttttgacaacgcaattacttttgcaccaacctaaaagaaacctagctaaactagaaaaataggtttgttcatttgattaacatagatatatgctctagaatctaaatctaaaatccaacctctctttaggatttttaccaatatttgatgacaaactacagctgtggggaatatagcattatccccaccactgtgtttactggtgagctagtcctcatttgaaatatttctcttcttatctctctttccttaactatctcttcctttcatcctttccttcccttgtccccccaaaaaacaactaaattttcttaatctagttgtttcacagacaaaatctgtagtccctagagtgtctatgaggtaggtaaagggcttatgtcctttgagaaaacagggtcttggtggaagactatgttaacatcaggcccgaagtgcccttgggggatagttacagaaattgggtcttacctagctgacaacagagtctggagaaaagaactacttcctgtatgcattaaagagaacttcacgacaccattatcttaaaatactcttctaagtatttcggacacacagacaattattcattcttcctttccttcaactaattttgttttacttcctacaatatgccaagcaccaatacaggcatcagaaataaatgatggacaactccagaaagatccctcacctatgggaatttataatctggtggtgatatttaaataacaaaaagtaaactaataaacaagctatctcaaagagtagtaagtattgtgaagaaggaaaatgtagtggaataggatagtaactagcaaggaatttaaagggatagagggatagatagagggatcccaagcaatcttcctgagggagggatacttatgctgaggcttgaagaatgaggaacagccaggcttgtaatgatctgaggaaagaacaatgcaggcactcagataggtggaacagccaactcaagactctaaagtcagaccaaacctagcacatcaagagagaacagtgtttgtaggtcaaattaagtgagggaagaaatgtggaaagaaaccaagttggtgaataggtttggcccatttatgtaaggtaaaaggtaaaggttaaaagtttggattttattccaagaacaatggcatgtcagtagaagttttagaagaggacacattaatgatctactttaattttgaaagatccctctggctgctgtgtggagaacaggatgaaaagaggcaggcgtggaagcaggaagtccaagtgagagacagctgcaattagacacgatggctcgcactctggggaaagaagcagagatgagaagttgactcatttcagatagtcaagtgctgaaggattgcaagtgggaggtgatgggctgagaaaagaattctttattcctaaaagatgagagaatgcaaaatgaattgtgagtcagagagaagccaaaggcattttttttgtggggagaaagaataggggccaggcacagtggctcacgcctgtaatcccaacactttaggaagccaaggcgggcagatcacctgaggtcaagagttcgagaccagcctgaccaacatggagaaaccccatttctgctaaaaatacaaaattagctgggcgtcctggcacatgcctgtaatcccagctactggggaggctgaggcacttgaactcgggaggcggaggttgcagtgagctgagatcgcgccattgcactccagcctgggcaacaagagtgaaatgccgtctcaaaaaaaaaaaaaaaaaagaataggtacaaaaatggtcatataatctatgacttctctatgaaataattcaattctaaaagaagggtgcttccttacacgttccacagatgtgcatccaacccatgtattgttctaatgagatgagtacagataggcaggtgagcaagggccattcaaaacacgcccaggtggcaacagcaataagagagtatgatggaagagggacaaaatgagtccttcctcactacttaacccagtgacctgaattagcaaccacctcccatcatgggaagcattacactgagatggcatcgtggacagaaagaggaagttaggcagtggcaacagaaactacttgctctgttcattaaaagataaactggaatgaagctggaaaccatcattctcagcaaactatcgcaaggacaaaaaaccaaacaccacgtgttctcactcataggtgggaattgaacaatgagaacacatggacacaggaaggggaacatcacacaccggggactattgtggagtggggggagggggaagggatagcattaggagatatacctaatgttaaatgacgagttaatgggtgcagcacaccacatggcacacttatacatatgtaacaaacctgcatgttgtgcacatgtaccctaaaacttaaagtataataataataaaatttaaaaaaaaaagacaaactggaaaggtttggagatgagggtgctccacaaaagatgaagagtattaactagttcctggtagacatttataataaaagaaaaaaggcatatgtaatacctgcttgatatcagagaaggtcttagcatcaaattagaccacatgtgctgcttagcatttcagatagtgtttggcccatggtgcttacaatttcatggattgatgattgattggatggtgtggaatctaggaagtatatttttagtacagtcattagttacaatagagctaaccgtgtccagtaaaaccttgtctcagactctaacagcctctaaatgcctttgaaattgtccttttggctaaagatggaaaaaaaatcacagatttcaagtcataaacacacaggtggagtggaatgaagtatctggaaataccttaacctggaagttaagagcagtgggtttagaaaaaagggaaattgtcatctaatactgagacttctgtgaaaggtaacaatgaggagattttgtacatccattaattttatctgctcataccaaacaacctggcagggggtagttactgttagcagaaaggggtcccgatctagaccccaatatagggttcttgcatctcacgcaagaaagaatttggggcaagtccataaagtgaaagcaagtttattaagaaagcaaaggaagaaagaatggctactccgtaggcagagcagcggcatgggctgctcagcagcttatacttatttcttgattctatgctagacaaagggtggattactcatgagttttctgggaaaggggcaggcaattcccaaaactgaagttcttccccttttgggaccatatagggtaactgacattgccatggcgcctgtaaactgtcatgcactggtgggaatatcttttagcaatctaatacattataattagcatataatgagcagtgagaagccagaggtcactcttgtcaccatcttggttttggaaggttttggctggcttctgtaccgcaacctgttttatcagcaaggtctttatgacctgtatcttgtaccaacctcctatctcatcctgtgactaagaatgcctaacctcctgggaatgcagcctactagatctccaccttattttaccaaccccaatgcctctgacattactaattctcatgttccagaagaagaaactgaagttcaagaaagctgtacaaagcccacagcgcacatctgggaatgtctaagaatgaccctccctgccccgcagcagccacaccttagcctgtgctgtaaacatgccgtacaggtgtggggagcacacactacggatggctgttgtctgacattgtggcaattccaaaaaaaggcaaaagcaggaaaacacactattcaactttaaataagcctctttgattttgctgaataataagtagttgtatggaaatgcattaaaattaaacttaccggcaagtagatgtcattaacaatataatagccaccatggcaatcctaaaaaaaagaagcagtggccacttttctgtagtctgtagacagcagtcagccaacagtcactgccctgggctgcccttgatggcattcagagtcatgctttttgttattttcccacaaaaggttagatccccgctatgcatcatgtccagaaaaaccttgtcaaactctcaaagtctctaaatgcctttgaaattgtccttttggttaaagatggaagaaaaaatcacagattccaagttataaatacacaggagaagtggaattaaaatctcataaataatattactggcaattaaaattctttgtgacttatacccagaattctcagagagcttcatgcacacacacacacacacacacacacacacacagtgtccagggtaatttcatatttactcaaaaactgtatgagtatatgcccaaattctaggtagagggggagtcatatattctaaaaatagtggaaattttaaaacttggaaactatttcagctccaagtttaaaatataaaaatatttcctaaacttattttttaaaaacactttattttgaaaaatttcaaacatacacaaaaattacaaaagtagtataatcatacccatacacctttcacctggattcactcatagttaacacttttccccatttactttatctccttcaccaaacatacatatatattttttcttgctgaatcatttgagactcactgacgacattatgacccttcgcaagcacttgagcatgtatctccaaagagttacagtctcttagcccccatacaattactaaatacaattaacattgaaaaatcatattatttaacatgaagtctatatttatatttcagcaatcgtctcaattacatcctttatgcggggtggccgggaggaatgatgcttttcttttttgtttttgtttttttgagatggaatctcactctgtcgcccaggctggagtgcagtggtgcgagctcagctcaccgcaacctccacctcctgggttcaagcgattcttctgcctcagcctcccgagtagctgggactacaggcaggcgccaccatggctatatatatatatatatatatatatatatattttttttttagtagagacagggtttcaccacattgaccaggctggtctcgaactcctgacctcgtgatttgcctgcctcggcctcccaaagtgctgggattacaggcatgaatcactgcgcctggcccagaatgatgcttttctaatccaggctccaatccaggatcacacattgcattcagcggccgcagctgtataatcttttatcaggaaacaatgacattgtgagatttgaagaatatggacaagttgttccatagaatattcttcaattcaggtgtgtctgatgcaagcatacttgtatatacctacagtaggccttttgcaaacccaagactgttacaaaacttaccataaaaatacagcaaggaaagaaagctacatgttatgttcagggactggtctcctgttaaagtgcctccttagatttgcatcaatttttctttaaaattatgactcacaggacttcctgcttttgtatctgccttgttcctctaattgttgtcagccagtcttcaaacaaaaacatcacatttatctatcctgactaactttccaagtcatttcgaaagccataaccctaaaccccacaccttgccttcaccttttggcaatcattgcagagttcctttacttaatttcagttcttttgctcctttccatagtagagagtctgtattgctattttcatcagttccttctgtatcagttagaaaggcatcataggtgcaacaaacagaaggaccaagcaacagtgacttaaacaaataagaacttaagaatctttttttcacataaagtccatatggacagtaagaggggaactacagacactggggcctacttgagggtggagggtgggaggagggagaggagcagaaaaaaataactattgggtattaggtttagtaactgggtaacaaaataatctgaaaacaaacccccatgacatgagtttacttatataataaacctgaacatgtacccctgaacctaaaataagtttaacacacacacacctgcacacactccagaagtaagtgcttgctggcattgcggcagctattcagccatgccctgaggctcctaggttcttcctacctttcctgttcctccattcttcaggcactggtttttatgttacattgactcctaatagatggaaagatggctactgtcactccagacatcaagttcatgttcaaagcaggaagaaggggaagagtgatgtaaagctggattttcctccagttaccaggaaagcaatggcttttccaaaaatttcccaagaagatttctagtttttaggtctcatggtcagaattgggtcacacagtcccacctcgctgccaaggaaacagggaaagccagaaacaggagtcaccttattgcttggggcagtcacctcatctaatggtgcagaacacagtgtctccacaaacaagatggggattgtgttaacagaggaaaatgggaaatagagaatcggtagcaaccaacagtttccctgagccctcccagtcagtatttatatttatttattccccacttctctattccatttcatatttcttctcagtttttcttcatttatcttctctccctagtacttcctcctgaagaatgaactttcaaacttttttattaacactccatctcccacctagaatcaaatagtattacaacagctggtactgcctcttccttcgacacagaagaaaacctaaaatccagtaagacagagtggcatgccaaatttgcccatcaatttattggcacattcaagaataaagcaaaactctactgaatatcgatatagtagtatctgcctctgaggattcttggtgcatatttttgcattctgccatgtttcgtccattttgcccctaccttgggcatttaaatataaagattcccatgagatcggatcaattcagctgtttatttctagaaatgtctataaagagaagaactaacaagagaaccatctttttatttttttaatttacttcctaaatataaatgaaggagaatctagaaccactgtcttcattggaaatcattgttccaaatgaaccgcaagtctgagtttataaagctgccatctccaatatgtctgttgagaaatatgtctatttacatacatcatgtttgtttctgaccttgtgggacaataacttggaatgccctgagcaacaaaaacataaaacactctgatgagacagcatctcatccttgcactgaaggatttcaaaagagggacagatcacccagaatggacatggtcatagaggaagtaagttagaagctataattgaccttcatctttttttttttaattttattttattattatactttaagttttagggtacatgtgcacaatgtgcaggtttgttacatatgtatacatgtgccatgttggtgtgctgcacccattaacttgtcatttacattaggtatataccctaatgctatccctccccctacccctaccccccaacagtccctggagtgtgatgttccccttcctgtgtccaagtgttcttattgttcaattcccacctatgagtgagaacatgaggtgtttggttttttgtccttgcaatagtttgctgagaatgatggtttccagtttcatccatgtccctaaaaaggacatgaactcttcattttttatggctgcatagtattccatggtgtatatgtgccacattttcttaatccaatctatcattgatggacatttgggttgattccaagtccttgctattgtgaatagtgccgcaataaacatacatgtgcatgtgtcttcatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttttttggctgcataaatgtcttcttttgagaagtgtctgttcatatccttcgcccactttttgatggggttgtttgtttttttcttgtaaatttgtttgacttcattgtagattctggatattagccctttgtcagataggtaggttgctaaaattttctcccattttgtaggttgtctgttcactctgatggtagtttcttttgctgtgcagaagctctttagtttaattatatcctgtttgtcaattttgtcttttgttgccattgtttttggtgttttagacatgaagtccttgcccatgcctatgtcctgaatggtattgcctaggttttcttctagggcttttatggttttaggtctaacatgtaagtctttaattcatcttgaattaatttttgtatagggtgtaaggaagggatccagtttcagctttctacatatggctagccagttttcccagcaccatttgttaaatagggaatcctttccccattgcttgtttttgtcaggtttgtcaaagatcagatggctgtagatatgcggcattatttctgagggctctgttctgttccattgatctatatctctgttttggtaccagtgccatgctgttttggttactgtagccttgtagtatagtttgaagtcaggtagcgtgatgcctccagctttgttcttttggcttaggattgacttggcaatgtgggctcttttttcgttccatatgaactttaaagtagttttttccaattctgtgaagaaagtcattggtagcttgatggggatgggattgaatctataaattaccttgggcagtatggccattttcacgatattgattcttcctatccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcattcatgatttggctctctgtttgtctgttattggtgtataagaatgcttgggattttcatacattgattttgtatcccgagacttttctgaagttgcttatcagcttaaagagattttgggctgagacaatggggttttctaggtatataatcatgtcatctgcaaacagggacaatttgacttcctcttttcctaattgaatgccctttatttccttctcctgcctaattgccctggccagaacttccaacactatgttgaataggaatggtgagagagggcatccctgtcttgtgccagttttcaaagggaatgcttccagtttttgtctattcagtatgatattggctgtgggtttgtcatagatagctcttattattttgagatacatcccatcgatacctaatttattgagagtttttagcatgaagggttgttgaattttgtcaaaggccttttctgcatctattgagataatcatggtttttgtctttggttctgtttatatgctggattacgtttattgatttccatatgttgaaccagccttgcatcccagggatgaagcccacttgatcatggtggataagctttttgatgtactgctggattcggtttgccagtattttattgaggatttttgcatcaatgttcatcaaggatgttggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcaaagtctgttattggtctatttagagattcaacttcttcctggtttagtcttgggggggtgtatgttttgaggaatttatccatttcttctagattttctagtttatttgtgtagaggtgtttgtagtattctctgatggtagtttgtatttctgtgggatcggtggtgatatgccctttatcattttttattgcatctatttgattcttctgtcttttcttctttattactcttgctagctgtctatcaattttgttgatcctttcaaaaaacgagctcctggattcattaaatttttgaagggttttttgtgtctctatttccttcagttctgctctgactttagttatttcttgcttcctgctagcttttgaatgtgttttctcttgcttttctagttattttaattgtgacgttagggtgtcaattttggatctttcctgctttctctggtgggcatttagtgctataaatttccctctacacactgctttgaatgcatcccagagattctggtatgttgtgtctttgttctcgttggtttcaaagaacatctttatttctgccttcatttcattatgtacccaatagtcattcaggagcaagttgttcagtttccatgtagttgagcagttttgagtgagtttcttagtcctgagttctagtttgatcgcactgtggtctgagagacagtttgttataatttctgttcttttacaattgctgaggagtgctttacttccaactatgtggtcaattttggaatagctgtggtgtggtgctgaaaaaaatgtatattctgttgatttggggtggaaagttctgtagatatctattaggtctgctgggtgcagagctgagttcaattcctgggtatccttgttaactttctgtctcgttgatctgtctaatgttgacagtggggtgttaaagtctcccattattattatgtgggagcctaagtctctttgtaggtcactaaggacttgctttatgaatctgggtgctcctgtattgggtgcacatatatttaggatagttagctcttattgttgaattgatccctttaccattatgtaatggccttctttgtctcttttgatctttgttggtttaaagtctgttttatcagagactaggattgcaacccctgcctttttttggtttccatttgcttggtagatcttcctccatccctttattgtgagcctatgtgtgtctctgcatgtgagatgggtttcctgaatacagcacactgatgggtctggactctttatccaatttgccagtctgtgtcttttaattggagcatttagcccatttacatttaaagttaatattgttatgtgtgtgtttggtcctgtcattatgatgttagctggttattttgctcgttagttgatgcagtttcttcctagccttgatggtctttacattttggcatggttttgcagtggctggtactggttgttcctttccttgtttagtgcttccttcaggagctcttttagggcaggcctggtggtgacaaaatctctcaacatttgcttgtctgtaaaggattttatttatccttcacttttgaagcttagtttagctggatatgaaattctgggttgaaaattcttttctctaagaatgttgaagattggcccccactctcttctggcttgtagagtttctgccgagagatcagctgttagtctcatgagcttccctttgtgggtaacccgacctttctctctggctgcccttaacattttttccttcatttcaactttggtgaatctgaaaattatgagtcttggagttgctcttctcgaggagtatctttgtggcgttctctgtatttcctgaatctgaatgttggcctgccttgctagattggggaagttctcctggataatatcctgcagagtgttttccaacttggttccattctccccatcactttcaggtacaccaatcagacgtagatttggtcttttcacatagtcccatatttcttggaggctttgttcgtttctttttattcttttttctctaaacttcccttctcgcttcatttcattcatttcatcttccatcactgataccctttcttccagttgatcgcatcggctcctgaggcttctgcattcttcacgtagttctcgagccttggctttcagctcaatcagctcctttaaggacttctctgtgttggttattctagttatccattcatctaattttttttcaaagtttttaacttctttgccattgatttgaatttcctcctgtagtttggagtagtctgatcgtctgaagccttcttctctcagctcgtcaaactcattttccgtccggctttgttccgttgctagtgaggagctgcgttcctttggaggaggagaggcgctctgctttttagagtttccagtttttctgctctgttttttccccatctttgtggttttatctacttttggtctttgatgatggtgatgtacagagggtttttggtgtggatgtcctttctgtttgttagttttccttctaacagacaggaccctcagctgcaggtctgttggagtttgctagaggtccactccagaccctgtttgcctgggtatcagcagcagtggctgtagaacagcggatcttggtgaactgcaaatgctgctgcctgattgttcctctggaagttttgtctcagaggagtacccggccgtgtgaggtgtcagtctgcccctactgggggggtgcctcccagttaggctgcttgggggtcagggacccacttgaggaggcagtctgcccattctcagatctccagctgcatgctgggagaaccactactctcttcaaagctgtcagacagggatatttaagcctgcagaggttactgctgtctttttgtttgtctgtgccctgcccccagaggtggagcctacagaggcaggcaggcctccttgagctgtggtgggctccacccagttcaagcttcccagctgctttgtttacctaatcaagcctgggcaatggcaggaggccctcccccagcctctctgctgccttgcagtttgatctcagactgctgtgctagcaatcagcgagactccgtgggcataggaccctccgagccatgtgtgggatataatctcctggtgtgccattttttaagcccgttggaaaagcacagtattagggtagaagtgatccaattttccaggtgctgtctgtcaccgctttctttgactaggaaagggaactccctgactccttgcacttcccgtgtgaggcaatgcctcgccctgcttcggctcacacctggtgcgctgcacccagtgacctgcacccactgtctggcactccctagtgagatgaacccggtacctcagatggaaatgcagaaatcacccatcttctgcattgctcaggctgggagctgtagaccggagctgttcctattcagccatcttggctccacccctgaccttgatcttaaagggtaagatctaaataggtgaaaaagaagatattcaggaacactgccatgagtccaaaaaagggaggtagaaacatcaataacctttcagggctcataagctagtctatatggggaattagtaaaggcacattggttaagaacacgtgttctggaatcagacggatctgcatctgaatcccatttccaccacttactggttccatgatatccaagcaatttattcctctatgctttagcttcctaaactataaaatcatgataatattagaacttatttaatggagttttatgaagataaagtgaaacaaggcatgcaaagtgcttagcctggtacctaaaacatattaaatgctctaaaacatgaagaaaaaaaaaagcaactactgaccaacatgaaaggagtcaatgtaacggactattaagttttaaaactgggttgtggacctaagtgtccatcaacagatgatggataatgaaaatgtggtatatatacataatgggatattattcagccttttaaaggaaagaaactctggcatttgtgacaacatggatgaacctagacagcattatgctatgtgaaataagccaggcacagagagacaactactgcaagatcctttttatatgtaggatgtgaagtagccaaactcatagaagtagagagtcgagtggggagtaccagggtctggggaaaaatggagagatgttggccaaaaaatgtgaggtttcttacacttctctttgttgaaggaccaagcaagtgactgaaacaaataagaattaaaaaatcagttccagagatctgtcgtacagcatggtgactatagttagtaataatgtgttgtacacttaaaaattgctaagagagtagattttaaatgttctcaccacaaaaaaatgctagcatataagatgatgattatgttaattggtttgatttaatcatttcacaatgtatacatatatcaaaaaaccacattgtacaccataaatatgtacaacttttatttctcaattaaaaataaataaataaatataggctgggcactgtggctcatgcctgtaatcccagcactttgagcggccgaggtgaaagtatgcttgatcccaggaattcgagaccagcctgggcaacatagtgaaaccctgtctctacaaaaaatataaaaatttatccaggtatggtggcatgtgcctgtagtcccagctactcaggaggctgaggtaggaggattgcttgagcccaggaggtcaaggctgcagtgagccgagatcacacactggttactccagcctgggtgacacagtgagaccttgttacaaaaataaataaaaataaagaaatttttaaaaaataaagacccactcaaaaaacagaaaagtatattgagaccagttggggacactttgacaataaggctgaagtgtcacaaaggaagttattaaaaatgtgttatctagatgtgaatacagattagaatcacagttgaggcagtaggaatggaaataaggtgtgaaatggaaatgctgttaagaagaaatacaactgcccttaatttaggatttttatttcttggctgcactaccagcataaatcaataaaactgactgttaccacaccagtaagtaggaataaaatgtgatagttggatagtcaagaaaagagttttgtcataatttgagacagatgctagaaatgtataagtacaaaatccgtggctagaaatgtataaatatgaaacctcagccactttatgtgttgggaaatatgtgcatttattcaataaatgcttactgaatgtgaactcgtgattatgacatctcactcatctgagaattacttatcctagaccctcaaaaactttgattcttcaaaacctaggcattaaaaaaaagaaaaacatctcgtcttgttttaggccctcattcagagcttatttgcttactttcacatagaaatgtaatatgtccaagtagccgtgtttttggccacagcaggttcaagttacaaaatagaaatgggaattagaatagtgagactacagaggcagacaaattaatgatagtagaagtgacagctggtagaaaattgtaatgaaaactataaaaagttggcaagagtctgtgataaatttttaggacaaaaatgccctcaaagggccctacaggtatcaccgtattgttcaatatgggaaccccagtttacaactagaggttaatgttatgttcaacagatttccaaaacttcaaaagtaaagctaaacacaaaaattatatcagatggctaggtgctatggctcacatctgtattcccagcacactgggaggctgaagcaggaggatcacttgaacccaggagtttgagaccagcctagacaacatagcaagaccctgcctctacaaaaataaaaattaaaaaatagccataagtggtggaatgatgctgaagtcccagctgcttgggaggctggggtgggaggatcacctgagcccaggggtttgaggctgcagtgagctctgatcatgccactgcactccagcctggacaatagagcaagatcctttctcttaaaaaataacaatatcagagacaccagtatggaaattttttgacaagttttgttaaaaaggagagataagaaatggcgatataagtggataattgataattgaatcaataaaatatttttgttttattttgtcctgttttaagaagggatacacaacagcatgttttcaggggctaagccagaaaaagaggtaaacattgatgatgcttaagagagaaatggagaattgctaaaatgtgtcctgagtaggagagaggggatggaactggaagctcaggtgaaggactgacacgggacagaggcaaagacagctcatccataacaacagcaaggaagcagagacaggagggtgacccgtggagagatgcactgtggggatttgtgcaggtacggggtaggccaccttctggaatgtcttattatctactttcagacaagttaggtcagaggatttctttatggctagctcttacacagaaaggcaggggaaggttagagtcatatttctaggttttatgactgatttagggggaaagggattctagtttctatggcctgccttgggggaagaagtggaacaggagaaaaaagggcaggagaaggccagagagagactttacttctgagccccttctaatgtcctccagttcaaagtactcagcatgctaaagtgccatactttgggatatcgctttctaagcccgaaaaatggcattgaatggtttcctactgattattcgccaatgctttgttcggggtttttcatcctgggcaccgctgacatttttggacagataaatctttgtttgggggaactgccctgtgcattgaagaattcttagcagcatccttgcactctacctactagatgccagtagcaacccccaagttgtgacaatcaaaaatgtctccaaacattgccaaatgtcccctgggtccaaaataatccccaattaagaaccactagcttagtcccaccttgttacaaaatatctagagaaaactaatattacaattcaatgattttttctctatagctaagaaaccgtatttttacactcttgaattatctgtaaataacgtcagagtttttttttattattaaaagaatactcactctttaaaagcaagtcaaatttttcctaagtatataaactgaaaagtaaaatccccactttcttctgccatttttggtccaaattcccaaagacgaccactgctagcagtttcatgttaacataccataattttataaacacaagcatatatgtcttttatcttatacaaataaaagcaaactatatatttttcaacatactttgtaacttaatgatatgccttgaacaacttattatatcagtggatatagatctacttcattttttcaaattgtttaactggttttcaaattgtgtttgtgtgtggtttccttttttgttttcttttgtgttttgttgtttaattttacttcctaaccagacattttagcaaattatttacacacttttgagactgggggcaatgatgtaaaaaaaaaaaataggtgtattgaatatttttcatggatcgtaaaaggacttcaaatgctggaaataagtcatagagtataattaaactcttagtgcttgaaaaagtcatagctgtgcggaaacattataaacattttaagtagaaatgatagatattttaatctgctccgctattgtaaccatgtcactagctatatgtatctcataatatcatgttgtaaagcttaaataaacacaatactttaaaaaaataaagtaaatctgatgcttggcagaaaatattttaattaatttatcaattacactcttactttattttaaatttaagtaaacaaaactacctttaatgcagtgactgcattgatttcagagcaatgatattaaaattttccatattaacatttaatgttgttacagaatgggggttataattttactgagttattgtttacatgagttccctagatacaaattgtaagtatttttgcatttctgtcaaaaatctgtaagagagtaaaaaacttagtttattccactccaataagtcactaagaacttagttcccaagaaatgtgtattgaaacgcttaaggttttagttctgagacaggaattcatgatttgaatataactcaggtaaaattatgtttcctcccaaaaatgataaccagccgtagcatagtcaccttactgtatgaaaagggtgcaatttactcaaaagcacattataaaaatatttccctgtacttgctctctggctttggtctttgaattacattgggacccaaataatgtcaaagagaaaggtgcaatagccgcacacaggttacagcattttttccttctctgtgcaccactcacacagaccccacgaaatgcatacaatgcacacaattttatggtcataggagaatgattcattcttagaaaaaagattccactgatatccactcaatacttgtgtctcacttggcaattggcatacgtgactgttcctctatttttccatctacctaatttcaaaggatttccagaaggaaaagaagatttaaatgcttcatttcaaatatttctgagttttgacaaaggtgccaagaccacacattggagaaaatacagtcttttcaataaatggttctgggaaaataaaatatccacatgtagaagaatgagattacacccctccctcttgcaatatacaaaaaccaactcaaaatgaattcaagacttaaatgtaagatgcaaaactatgaaactactagaagaaaacataaggggaatacttcaccacattgggcttggcaaagattttttaaataacacctcttaaatacaggcaacaaaagcaaaaatagacaaatggattatatcaaactgaaaagtttttgcacagcaaaggaaactattaacagagtgaaaagacaacctacagaaagggagaaaatatttgcaaactgtacatttgacaaggagttgatatccaaaatacataagaaacttaacagcaaaaaaaaaaaaaaaaattgaaaaatggacaaaagaccttaatggatgtttctcaaagaaagacctacaaatggccaacagatatatgaaaaaatactcaacatcactaattatcagggaaatgcaaatcaaaccacaatgagatatcatctcactccagttagaatggctattatcaaaaaaccagaagaaaactagtattggcgaggatgtggagaaatgggaacccttacacactgctggtaggaaattagtgcagccattatggaaaactatggagattcctcaaaacattaaaaatgaaactaccatatgatccagcaatcctactcctgggtatatattcaaaggaaataaaatcagtatgttgaagagatatctgcactcttatatttactgcagcaccatttgcaataaccagggtgaggaatcaacctaagtctcagacaacagaataatggataaaagaaaatgtggtatatgcatataaagatatacagttcagccacacatatattcagccataaaaaagaattaaatcttatcatttgtgacaacatggatgaacctagtggacattatgataagtaaaataagccagacacagaaagacaaattctgcatgatcgcattcatatgtgaaatattttaaaaaggtgataccataatatcatagatacagagtagaacagtggtgaccagagcagagagaaggatggggagaagttggtcaaaggatacaaagttacaattacatagaaggaataaattatagtgttctattacacagtagagtgactatggttaacagtaaattattatacattatgaaatagccagaagagaggcttttgaatgttctcaccacaaagaaatgataaatacatgagatgatggatacactaactaccctaattgaatcattgtataacatagatatatatggaaaaatcaaattgtatccttaaaatatgtataattacaatatgtatgtatcaatttttaaagtaaataatttttcagtatttctgctgttgggatttaaatgtttaagcatgtttccaagttgctctcaaatttttaactaataatttaggtttgtatgtgttggagtagtttttcagttaggaaatttttttaattgataaattccttaaagtatcagtttgtttgtttgtttagagacagagtctcttctgtcacctaagttggagtagtttttcagttagaaaattttttaattaattgataaattcctttaagtatgagtgtatttgtttgtttggaggcagggtctcctctgtcacctaggctggagggcagtagtgcagttgtgaccatcagagttcactgcagcctcaaattcctgggctccaaggaatcctccagcctcagactcccaaagctgggcttacaggcgtaagccactgcgcccaacctatgaatggtttttacacaagatgagaatattcaaattaaaaactgtaattcaaaaaaagtctaattttaagtatcactaaaagcgagatgcatttatatccacattaagtgttaagttaatccatgctaaaagagccaaatgcctcatcattgtcatggagtcaccttcactgactccactgcttcactggagctccagtaggtgtttcaattccattctgagtttcttttgctactcgatctctgttaaaattattaatgtcctgctcccagtgccttagaaactcctagtgcatagatatattcagatatattaaatatttcattgatttgatcagaaagccttcaaaacatcttgagaaatatatctactaagccacacatttttcctacaaggtaagcctactaatacctgcattacataccattttgttaaacttttctatctcacctgtttgttcttgatctgagaaggaacttgttctcacctttaggagtaaataagtttactttttaaataagcaggaaaaattattcaaatgaagccatcaccttcctcattggtgtcctcattctgtgtgctctaatgcttggtgcatacatttgcaaatgcacacacagccgggaggaacacagaaacagtggcaggtagttgcttcctccaattaaacttcatatcagcaaatcattgagccttccttattcatagccaaacaacacacagtcatctaaacagagattctcagtagagagtagcctattggaattgagcaatgggtagagtagggcacatgtggtttggcatagcatattcaatattttaatataaatatatgtttgggaaaaccattcctcattctttccttaataactacaaaaaaataaagctgaaccaaatgttcttggttggtggggagccacaaaagatatatagtcttaagcaaggtatatattcacccctatgagaaatatatcaaaaccttagggaagttgtataaaatacatttgataatcaaaacttaacatagattttgaaggcctgagaaatcctgaattgatataaattctaaacgaggctgctgctggtcatgtatagaaaaaatagcttttgggtacagaaaagctgtagacatgaaagagtgtaattgaagaagcaagctaagtgatcagtatttttaaaactactcagtacattcaaataatatatttattatagaatcaatcaacaatacaaccaaatatgaacacaaaaattttaagtgacagctgtcgtaatattagcctcaacagattttgaaatctcactcttcatttaaacaaagctggaaagatgcttattcaagatctgtgtttacaaaaaaaggttaatctggttgcataagttaaaatgttgaccacttacactgtgttaaaatttttacatatttaacaaagttatatgtgcctttactatcatatttttagtttgaaatgtattttgaaaaataaaattctggctgggcacagtggctagggcctgtagtcccagcactttgggagaacaaggcaggaggattgcttaaggccaggagttagaggctgcagtgagctatgatcatgccactgcactccagcctgggcaacagcaagaccctttctccaaaaaaataaaaataaaattctagtcaaagacttgcaaaaactgatgtaccttcctgaaaccctaattttattcaaccatgtttaataccattagatgaatgtaaccacttattttccagatgatgaaacttaagctcaaaaaatttactgaaggtcacagatctagaaaggtgacaaataaaggctagacccccctgccccgctgcattgattcccaatactgagcttttttcccctataccaggaatagatgtgatttaaaaaattttttcatatacctattacttatccaatattaagacaagcatccgtgagttataattttatggttgatgtatttacgacaaaaaagccacttttttctactttaatgtgaagcacaagatggtatcacgcaaactaggaaggtagaaattcttcatagaattgcagttgtcttttcaatggcaaattggtatctttacacaattctacaataatttttctgttaagtacttctgactgttgcactgatattagtgaatttccataagcttgataggtgaaatcaaactatttaaccttaggtcagagaaacatcagaactatgaatatacattcatgtaacaccaagttataaaatgtttacaagttattttactcagtaaggacttctttcccaaagagtaaagacaacttctattctcctattccaggaaagtttacataatgtctgcaggaagaaaaaggatggaaagctttcctctggctttttctccttcagctgcatggatgtgactaacccaggtagctgcaggtaatgaagctggcaggctgcctgagaccatcctattacactgagcacatcacataaagtattgtctacatatcagtcccaacaatatctccacaccgtaagccatctttttacttcccagacatttctcttggggcttccagtagactgagtcccagagaaagatttgatagctcagggatgatttttttcccaatcagcccaacagggaccactcatcccaccaagcctgaaggcatttgtatggcagttcacacctgaggctcagatagcatggactccttctattgctgtccctacatgccccatcagtctttcacttactccttcaatcaccctttcaagtaaattgccaacatgagctttttcatgtctggaatgactctgcagaaaggacacttcggagtttctcgatgtatcagttaggaattcactttcttgcaacaaaagaaaacctgacccggcatggcctaaacaaagaagcgtttatttttctcacctaaagaggagtctgagtagcctgatgattcccgggttggcattttgtaggtatctgtgggtttccttggtcttgccagcacgtgtgttgcctcatagatgcaaaactgttgctgcagtttcacacgatcatcccatcatgttcaaggcagaaagaaagtggaagacaacagccccatccatctcttgtgtcaagaaagctagcacctccaggacttcctcagcagatgtctgcccacgtctcactggtcggaactgtgccccttagacaccaagaagccggccagctgggaaagaaagtattttgctttccaacttctttaacggaagggcagcaagagagaagggttttgggaatcactgttgaatcaacaaacgaacagtgtttattatacttgggtttaaaattaataatgcatttattatagtaacaaattcaaaaaccgtgtttgccttcagcctttaacttcaatttacaaacctattttctacttataaatcttgtaaaataaaaccaatctccttcactttttagtttataaatgtttaactcaagttgaaaaaattgaacttaaccagtctcattcaagacaaagaataatgaactgttttaaacagcatcttaaatgtaatgattaattttatttgaaatacaagtggattatccctaatctgaaattttgaaatccgaaatgtttcaaactctgaaacttcttgagcactcacaagatgccacagtggaaaattccacacctgacctaatgtaattggttgcagccaaaatgcagtcaaaattgtttcatgcataaaatcattttaatattgtataaacttactatcaggccatgtgtataaagtatatatgaaacaaataaattttgtgtttagatttggatttcattttccaaaatatctgagaatgcatttgcaaatattccaaaatctgaaaaaatctgaaatctaaaactcttatgtttccaagcattttgaataagaaatacacaatctgtatttttttctttttttctttttttttttttttttttgagacagagtctcactctgtcacccaggctggagtgcagtggtgtgatctcgtctgactgcaacctccacctcccgggttcaagtgattcttgtgcatcagtctcctgagtagccaggattacaggcgtgtgctaccatgctcggctaatttttgtattattagtagggacagggtttcaccatgttggccaggctggtctagaactcctgacctcaagtgatctgcccacatcggcctcccaaagtgctgggattacaggtgtgagccactgcacccggcctcaacctgtattttaaatgcatgcttaaaaactttagaaaatccaataaaacgtattttaaatatagtaaatgtcaagttaccttaaatagtccagtgctgcttatacacttaaattctcttacaacgtaaaatcacaagtttgaacttaattgcctgttttaagttgaaattagtaggttcatctgttattccttaattgcctaattctcttaatcataaaaaacactccaaccccccaataaacacgggttattctcacattaaaatataatgccaacactatacatttgattaattttattgtctctatattctaaaatttatcacagtttaaaatacacatatttcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaatacacatatttattaaggggagaattttatcataacagatcaacaagagtttcatctcaaacaagctgaggttacttttgagccaacaattttttttaccaggatatatatcttgagtttcctataactgggatgattccacctgaagcttttgttaaaggaaccccgagtgcacacccatccggggcagttgatcttaaagtacacatcccctgtgttcaagtttcccagaggaaacactttttctttgcccttatgctcaaggactgggaacctgcaaattaaaccaacaagaggctgatttgtatgcatatggcagctaactaaagtaatagctagcttgccaaacagttaaagttagaggctaatattcctaagtaggggaaagggagaggaagaaaagccttccatgggaagaaaatcatttctttaggaaggacaaggggatttttagaagaaaaaacaggagataaagtttgtgatgatgtttctttatgcaggcgcatgtagcctatccatcctttaaggatatgagtttccccagggaagggatttatgacaggtttactgtcagtctctttcctgggagtagactcacccaaaagagggaatttagggaaggattatttcccagaagtttcagattttagtcagataagggaaactctgagaaagcttctttctgcatctggcatctgttgattctcaaatgtcttcaccttaaaatgatctttgtaccaactctggggttctgagtgggtccccacacctgttaaaagataatttaaaaagaagtagaagtgaaaggagaaggaagatgaggtaaaatcatgatattcatataaatataaaataaaaatgtctcaaagacctcaaagactttaattcatttactaatgagggaaccagtaagatgttacaaataattcaaaggagaattcaatgcacacacacacacacacacacacacacacacacacacacaccccaacaggaatactgaaataaatctgattaacacatgcaaaagagaccaataatctatggggcaataatcaatgtatctcacaatctgcatctatctgtcacatataatctgcatttctatcaacaataaatcatttgcgttactataagtattctacaacttacagagttgtaacatatactcataaaacatttcagttagcaatggaacagaccctgtatatgacagcgatcccataagattacaatggagccaaaaaattcctatcacctagtgacattgtagccattataacattataatgttataacattatattatataatgttatatataatataatgttacatattatataacatattatatatataacataacataatatataatgtataacatgttatatataaatgttataatatataacatatgtatatataaaacataattatatactgttataacattataaaagcacaattactttaaaaaaaacttaatgtaaggtctgatcttagaaattttgttattgggctacccaatttacagcctttaggagtcataaatatgacaattccaacactaaactattcaaaagttggcattccagccatacctgaaggaccctattcaatgcaactggtgatcgttcacattcccataacaatatgttttcatattttaccccatatcctgacagttccacatgtagagatattttggaaaagctaccagggtacaggggtgggggacatttttaaattgttatatacaatccctactgtcttataagcagatctaaacacctacctgtggttatacaaatatttggaagaagactaaattactctgcatgagaaataaataaaagatacaggagctgagggcagatccaaaccttgagaacagtggcagccagggaggctggaaactcagtgctggaaaagctgaatccttttcatcctccaagccagagagactccatgacaactgtcagtctaaagaggatagttaagataatttgtactgaaatataaactctgttgtctctcaccctctcaaaattgtcaaccacttaaaaaaaattgtgaaccactgaaatatttaggctggttcaggactaaaacagcattcagggcagatggatagctgggttacacaacgagagcatgtttacttgctcttctaggaactattacttctgtaactctttgggcatacttttccagagggactcaatatcattttttctattgatttgtgttattgcactgtgaattattgctgttcttaaagatatggttccatgctaaaaaggaaatgctttttgttttttactttcccaacgtttccctataaacatcacttactggccccttgcctttctacttctgttcctaaacaattgagttctaaagccatttggtggatcagaaggaggtatttttctgtgttgagtgtgacagagtagtggtccagagaagaatttcggagttccactggggtgagaagggcatccttagagggggctggtgcctggtcctaaacagggtggggagagtgctcatgtaagtgagagtctgcactgagtaaggcgaggagagcatccatgcaggaaagaggatctgtcaagataataaatatattaagttaatagaaagcaagcttctctcactgtcaggaaagggagtaacagatatgtaaagggagaaaattagactgagcctgtagtgttggataagaactggagatgaactcatagttttcagtattagaaatatacagagaaattaatacagatggaaatgtgtgtatgtatgaataaccatacatatatttcctagtctgtccactgagagacctggtggcagtgatactccactatcagtgagcttaccttgtgtctacatcttggcttctaaataccattctacccagagaggacccagagctccttagagaaatggctagttacagggctatagcagggaaaatgcaagatgatcctgaaacatcttgtagtgccagaaagcaaggaagagtgctcaaaaaatgatgcataaatattacaaagacaccaaagctaggttaaaagagttcctactggtccaatttgagacaacttgcacatcagaatacataataataatcaacagattgtaacccattgaacaaaataggaagccataagtctacctgatagaaataagtaaatgaataaattaacactttgatgaggaaagggacttttgcagtttcaaagtacccctctacaaaatatgtattaattacaaaggaatttgggtgaaaccactaatggaaaaaattaatatcttgtactacctgacaggttgaaatgagcatcacttgtgtgaattttatgccaaagatgcataacctgaatctaattatgatggacatcagacaacccaaattcaggaacattctacaaaataattgacttgcatttttcaagggtcaaggccatgaaaatgaaaagaggctaaagaaatgtgacaattaaatgcaaggagcgattccaaaccagatccttttactacaaaggacattttgcaggggcaatatataaactttaatgggttctgaggtttaagtggtagtaacaactccatgttaaattcctgattttaatggttctatttacataggaaaatattcttgtttgtaggaaatactaaagtatttaagggtgctagagcatcaggtcaaaaacttactttcaaatggtggggtggtggggaaatgttctttatccaatacttgcaacttctcagtttgagattatctcaaaattttaaaattatctcaaaattttttttttgagagtttcgctcttgttgccgaggctggagtgcagtggtgcaatctcggctcactgcaacctccaccttcagggttcaagtgattctcctgcctcagcctcccgagtagctgggattacaggcgcccgccatcacacccagctaaccttttgcatttttagtagagatgaggtttcaccacgttggccaggctggtctccaactcctgacctcagatatctgcccacctcaacctcccaaagtgctgggattacaggcataagccaccacacccggcccaaaagttacttttaaaatatcactttaaaatatttaagattcctgatatagctgttgaatcataatgttatgaaaatgtagaactaatttcatgataccgagaggtgacagcgtgctggcagcccttgcagccctcgctcgctctcggcaccccctcgccttggcgcccattctggccgggcttgaggagcccttcagcccaccgctgcactgtgggagcccctttctgggctggccaaggccagagccggctccctcagcttgcggggaggtgtggagggagaggggcaggcaggaaccagggctgcgtgcagcgcttgcaggccagcgccagttccgggtgggcatgggctctgtggccagcactcggagtggccggccggcccgccagtcaggggtagtgaggggcttagcacctgggccagcagctgctgtgctggatttctcgtggggccttagctgcctccccgcttggcagggctcgggacctgcagcctaccatgcctgagcctccctctcaccccgccttgggctcctgcacagccggagcctccccgacgaccatggccccctgctccagggcacccagtcccattgactgccctagggttgagaagtgtgggcgcacggccgggactggcaggcagctccacctgcagcccctgtgagcgatccactgagtgaagccagctgggctcctgagtctggtgggcacttggagaatctttatgtctagctaagggattgtaaatacaccaatcagcactctgtatctagctcaaggtttgtaaacacaccaatcagcaccctgtgtctagctcagggtttgtgaatgcaccaatcagcactccatatctagttaatctggtggggacttggagaacctttatgtctagctaagggattgtgaatgcaccgatcggcactctgtatctagctcaaggtttgtgaatgcaccaatcagcactctgtgtctagctcagggtttgtaaatacaccaattggtactctgtatctagctaatctagtggggacgtggagaacttttgtgtctagctcagggattgtaaacacaccaatcagcaccctgtcaaaacagaccaatcagctctctgtaaaacagaccaatcggctctctgtaaaacggaccaatcagcaggatgtgggtggggccagataagggaataaaagcaggctgcccaagtcagcagtggcaacccgctcgggtctccttccagcttgtggtggctttgttcttttgctcgttgcaataaatcttgcagctgctcacgctttggattcacactgcttttatgagatgtaacactcacctctaaggtataaagcttcactcctgaagccatcaagaccacgaacccactgggaggaatgaacaactccgaacacactgcctttatgagctgtaatactcaccacaaaggccttcagcttcactcctgagccagtgagaccacgaacccaccagaaggaagaaactccaaacaaatccgaacatcagaactctagactcgctgcttctaagaactgttaacactcaacgcgagggtctgcggcttcattgttgaagtcagtgagaccaagaacccaccaattccggacacaatacaatcattgaggagctatatctgccactaaatataaattttaaagactggacataaaaagataatattcagaaaagttatgtggagaagaatattcaaaagagctgcatgaaaacacaggcaggtatggccagttaaaacatcttcaaagtagctgtagctggaggctaattcattaaagaatttttcttaaaatcttggtgtttaaagtgttcttaaaaaattaataaagatataaaaagttagtctcaacacagattggtttatttgtatgcttgagatctctgaaatacgtgatgttctgccagtgatggcctttttttttactttgttttaaacaattggttgaaaaaagattaattttgaataatttcacaagtgagaacattatttgtagcacagctcattattatatacatttgactatgtccttcatcaaactatgtgctctgaaatgactacgtacaaagcctttcatacatggattgcttctctctatgagaatgttaattgccctgttattaagaagtcccgctatacttcacaaaggaagtagtcacttttattttttcatgctttgatcattgaccccaaatacatttttacataataagcttttaatgattattcaaactattctgttcttatttcttcataattataagtattctagaaagttccaaagatttacaaacttggtaaggataatgggagcataactgtactgggagtctacagatatctttgaaattatatgaatctcagattttaaagtgttatagttaatatgtggccaacacaaaaacctgcacacaggtgtttatagcagcttgttcgtaattgccaaaacttagaagcaaccaagatgtctttcagtaagtgagtggataaatatatattagtaagtgtgagaagccagtttgaaaaggctacctactgcatgattccaatgacataacattctggaaaaagaagaactatggagatagtaaaatgttcagtggttaccagaggacttttagggcagtgaaactactctgtattatactataatggtggatacgtgtcattatacatttgtccaaacccatagaatgtataacatcaacagtgaactccaatgtaaactacggactttgactgacaatgatgtgtcagtgtaggttcatcaactgcaacaaatgcaccactctggactggggagagtgttgatggtggaggaggcagggactatatgggcactctctgtaccttttgctctattttgctgtgaacctaatagctataaaaaataaggtctactttttaaaatggcattgttgcccttcaaagtcagaataggatggttatgtgaaacgttatcaaatattcatacctttcaattgtttatggaacaatttttactccttaagtttgtctcctctaattttactattcaacaagtaattttcagcatccctaaccagagatacaaacaaataacgacaagggctttgtttacaatgagtgttcttttttgttggtggggggtggggataagattaaagcattcgaaacaattggacaaccaatatgtgatgaaatttaattaattgattgttagtgtagatgagtgtgtctggtgcaaagaggttaaagtggactgctttttgaagtattgatagttttaaagttcttatagtgctcttcattctattaaatgtttatttgtaggggtataaatatagcaaatcagataatatttcaaaactttaatatttaaattagcttggacactcaaacattctttcctagaaacgcaattgcaaataatgactaatttttcttcaaaaaaggaagtaaaagaatatttatctaataggattagaatctcacctagatgcaagccaataaagtctgagtcaggaattccaacaaggctggagcccaaatttcaggaggaagtgatagtgacgagggggaatggtagtgatggagaaggagttccaggaatcggggaaggtataaaaaaccagaatgggacttctggattgaagatggagtttgaaagtgttgaagtgagtgagaaagtattgagctgagttagaaaactcacatggtgaagctcttgggtaaggatggaaatgaaggcaaatgagctatctttattcttgcaccctacctttcccccagagagtctcagtggtggcactgccatgcttccagctggtcaagccaattcagaacattctgtccatttccattctacccctaaattacatgtcaaatatgttcacttctctcctctccactggcgccattctagactaagcctcatttgtctattacctggagcactgcaaagtttcctaatcagcagcccagctttccctcctaccctcccctcaagtctcctacccaatggcactccatcccagtagccagaattatatgaccaaaacatacctgtttcctaattggccccttggcttcaaattcttcattgattcccctttgcattttaaataaaacccaaacttcttccctttgcccaaggatacttctctacctcatcaacctcagctcatgtcacttgtccctgctcactgggctccatcaccacaaccctcccagagttccgtaatcctcagcctgaagcctcttcctcaccactttaactaccaccaccacttccccactcctacctcccctactctcatgggtgatttccttttcttcctccagatctcagcttaaatgacaccattttacagcggcctccctctaactaccccttgtacaaagcaccagcacacagttattttccattacatcacctgttttctttctttttggacctctccataaattgtaaatatttattaacttgttcaatgtatcctccctgggagatggtaacctcccctagggcaggaactctgtttcattcaatgatgcatgcataaaatcttgcacagggccttacacttagcaactatccaatatagaaatgatcacatggcacctgctttcctgttatcctctatgtcttcttgtttctccaatactaatacaggagttattaagaaattattttaggcagttagggtaaaagaggctgggcgcggtggctcacacttgtaatcccagcactttgggaggccgagatgggcggatcacctgaggtcaggagttcaagaccagcctgaccaacatggtaaaacctcgtctctactgaaaatataaaattaggcgtggtggtgcatgcctgtaatctcagctactcaggaggctgaggcagaagaatcacttgaacctgggaggcggaggttgcagtgagccaagattgtgccgtggcactccagcctgggcgacaagagtgaaactctgtctcaaaaagaaaaaagaaaaaaaaataagaaatggtaaaacagtcctcggtggaattttcctttaataaaaagcagccccaaaccatttcttttctaacagaagcagcctgaaaagtcaagctgcaagcacagatatgcaagctggaagctttcgtatgtaaatgtcagcagctgtacctggaagccagatacattcaatgtggcgattcccgctcccttttccttatcaccatgtgtgtgggtatcacagcactggccaggtaaagccatgtgtgcaggtgtcagggtgacagccaggtagaagccacatttgcataataaaagattagggtgggagggccagtcttttaggtctttttgcaggctatgtaaatgacacacctggtgaaaccaatcccctgggctctatgtaaatcaatcaccgcctcctcaagcctctgtacaaaatcaatcgtgttctgccccaaaacccggaaaccctctcttgggccaccggctttctcatcatgaggaaactttttctctcttcttttttgtctattaaactttcctctccttaacctactccacgtgtgtgcccgtgtacttaatcatctcagggtgagacaatgaaccacaggttttccacagacaatgaagtcgtttcaataccagaccagccttgattctgagcccatagtaagaatacaacaaattcctgtttttaaaattattggctgaaaattgtttgtagaagacggtaattggattgaactgtgaagtatgggcagacgtttcatagaagagaggaatggagaggcactccgggtgggaaacagcatgaacaaaggcaaagaggaaaatgttggcatcttctggaatcatggaaagaacgtcctaagaggtgaaggttcctagaaaataactggcatcagggttgtatgtagaaaccatgatgagaaagacaaatgattataaaatatcagggagaaactgctctttgccacgcctttgtattaaccaccttcaaactttgtgtcttctccccttttcctcagtttctcatgggggtggacaggatgtcaagtgctcccttggctatttcccctgtgggaacatcacaaagtgcttgcctcagctcctgcactgtaacggtgtggacgactgcgggaatcaggccgatgaggacaactgtggtgagtgaagcccctgcagtcacggtgagagaaaggagcagaaaggactgaaggtgaagtcgctgagacttctctcaacaaaaagacaaaactaaattgaaatacaaaacatatgttgcttaaggaaatcttacacttatttcagtagcttaaaatatccactcttttcttttcttgtttttgtttttttttgagacggagtctcgctctgttgccagtctggagtgcagtggcgtgatctcggctcactgcaacctctgcctcctgggttcaagtgattctcctgcctcagcctcccgagtagctgggactacaggtgcccaccatcacgcccggctaattttttgtatttttagtaaagacagggtttcaccgtgttagccaggatggtctcaatctcctaacctcgtgatccacccacctcttcctcccatagtgccgggattacaggcatgagccaccgtgcccacccttaatatccactcgtttccatgtaatggtatcacagccaatattccaggcgagtggtggttgctcacagagtaagttttaaccaagattgtccaacccgcagcctgcaggctgcatgcggcccgggatggctttgaacgcagcccaacacaaattcataaggattttgaaagcattagattttttttgtgattttttttttaagctcatcagctatcattaatgtaagtgtattttatgtgtggcccaagacaactcttcttccaatgtggtccagggaagcccaaagactggacacccttgttttaacccaacaaacctgcccaagtaaggtgttagaggcagaatacggttgaaattgagaatacgggctctggagccagactgcccaagtttgaacctgggtatgacgataagcaattatgtaagcttgagaacatttcctagcctctctgtacctcagtttcctcatttcataaaagggcatggtaattgtgcctatactctaagaattcaggaagattaagggtacagaattagaagagtactggacatctaggaggtgctgtccaggtgttggatgctgttgccctttcttatcttttgggacgaaaagtgagttcttctaaaagagacaaaacaaacaatatgtaaatacaacttacttcctacttaaccaacaaccatacctctggatttataaagccagtaagtagggcttctggccaatttgaatatgggaaaatagctttcagttagaattttgttcaaacttctgaagccttgaaaatacaaagttagaacctgaattgtttggatctgagtcactgggaaaataaacttcggttaataatgtaaagtagtaagatttctcacctgtcaagaaataaggtactattttgggaggactaaaagatgcataacaatgctattatgcaaagtgtcacataaataatatatgctaatgaggccttgctgtgatcactcccccaagtatttcaggctttttaagaaaccaccttgaaggaattaagtttccgttaacataaaataagatgaacacctggcttgaaaatcctcctacttgaaaaaaatcagctaggtcacacaagcagaccttaactgagctaatttcttgaatgtaactgaaacttaggttgtttcttgtaaatgcctctgataatcacaaacaaaacttaaattgtctttctaaagtggtataaggtaaatcacttttaaccagtccgctatcacctggaaaccccgttgtaataaccagtcatggaaaaggttgaagaaattcctcattttcactttatgagcaatcctataatacatgcctctgagctttcttactgcctgggctgaaatctccctgatatcgagctgtactttctcttactgtatgataataaacttttaaatttttataacttgatctgattttatttttgccacttcttagtttgaaacactatttctatgtgatggcagtaactcaagtataaccacactatctaaactagtgagcttaagctgcaattgtatttgatttggatggctataaatacgttttcatttatttaaaaaaaacaacgtcttgttaaaataaattaatattacataattttttaattagatgaaacagtgttttgcccactgctagtcagttccccgtcgacctgctggcagttcaaatagagagttctagacagagcaacaggaaaacttcactccaattaaaatggcagctggaagcaggaaaggaacgtggtgggagtagcaaatttaccagcaaatgtagcttctcagtggaaaaaaagcttgggaactctagctttagtgctaagtttaaagaggccaagtagcaaaagtagcaatccttacagtaataatccttaaaatcatgcaagtttctcaggattcaccaaaaagcacatttagacagaggcaatagggcattggggtttcagagagaagtttagaaatcagagttaaactctagctataaagggaggcaaaaaatggcttgttttcttttctataaaacaggaataataagagtatccatgttcatgggttgttaacaggattccatgagataatgtatccgagatgcttagcagagtacaggtgctttggactgaatgcttgtgtcccccataaagtttatatgttgaagccctatcccccagtgtgataggatttggagatgggatttgggggatgtaattaggaatacgtgaggtcataagagtggattagcatccttatgagtcctaagggagcttgcttcatctctccaccatgtaaggaaacagcaagaatactgctgtctgtgaaccagaaagtgggccatcactagacatgactccaccagcaccttgatcttggacctcccagtctccagaactatgaaaaataaatgtttatgtttaagccacccaatctatgatacttagttatagtaacttgacctaagacaataggacatgaaattagcactcaataaatgttacctagtgttatcagttagctgtaattatattacaaacatagtggcctaaaacgtaaccatttatttagcttatgattcttggggtcagcaattttggatggactccactgagatcagctaggcagttctggtctcagctggattttctcaagcacctgcagtcatctgtggatcagctatgccatgatgcctgggaccttgtctgtgtccttaattcaccattgccaacgtttgaaacctctcaagtccagttttggatatctgggaaagatcataattcactcttataaagacatgtctatgtaaaaaataactatttcaatttgttactgatcttcttatgccagaatcacataactttcttgaaattcacctagaccactggatctccaaaagtagtcctgagaccaaattcatcaacattacccaagaagttgttagaaatacacattttggccaggcccagtgactcacacctgtaatcccagcactttgagaggccaaagtgggaggattgcttgagtccaggagttggagatcagcctaggcaacatggcaaaaacctgtctcaatattttttaaaaaagaaaaaataattattttaaaatatttatataaaaatttaaaaaaagaaatgaaaattctcaggctccatcccagacctattgaatcaaaagctctgttttaatatgagcctcgtgtcattctaatacacgctaagttttgagaaccatgaacctaaacccaatgagcagaaaatcaggaatgcatgcaaaatggtagcaacagcagagatacattagaatcaagttttcaatatggtacacaagcattctaacttgctcacaaactccattattatcaattatctacaatttttagctcctctaggaaaaccggtatgctagtagtggcagtcatctagaaatagaaaaaaaaaattaattccgttcaaaacctcaaagatgcccagttggcatgctgctgctgtccatgcaaaaatagactggaactttccaggaaggatggcagaatttcatcaccatctttagagtccaggtgatggaaaaattatgagatgcagttatttctgtttgtctctaattgctttaatttcccttgcaaactgagtggttttttccttcattttatagtatctggatcatttatgctcccaaggctgttcttttcttcttcttcttcttcttcttcttctttcttctttttctcttttgagacagtctcattctgtcacccaggctggagtgcagtggcgtgatctcagctcactgcaacctctgcctccaggattcaagtgattctcctgcttcagcctcccaagagctggggctacaggtgtgtgttaccatgctcagctaattttttgcatttttagtattgatggggtttcaccatgttagccaggatggtctcaatctccagacctcatgatccaccagcctcggcctcctaaagtgctgggattacaggcatgagcccaccgcacctgatcggctgttcatttttaaaacatccatatgtaaattctgtttaatactaattaaattaagtcagaaagttgcttcttttcagaatatgtaaacctcatgcatattttccgtcatgtaaaatacaatatcttaacatacaaatataagaaaaccccataattaaaaatcatttttagagtaataacttacaacttaatagtatattgtcaaataaaataccttcttttaatgaaagagttttttcttaattagaccttttaaggtatatcttaaactccaaaaacctctcccttattctgtcaagctatttaaaccttgacactaataataattattaaaatggaaaaataagtcaaatggaaattgtagaaataaaatttagggatatcgctgaaaaaaatgaaacaccaaatgaattaaactgagtctctatatttgaactaatacatgaactaattatatttagaaagaactgtcacttttgtgttatcgcaggcactttaaacaagtactcttatttagtacatattaaggtcccagttttctcagaaaacccataaataattaatttccctgtaattaaacactttattaagtataaaaaataaaatatttcagcacaaagagcatgacattaactcagtgaagattttttgtgaacacaatgcaagcaaaatcaatagatttaaaatttttcagttgaattcatatgaatccttttttctaaaatatttacacaatatggaatttacatgtatacagacatacatatatcaaaaactgattacactatttttataataactttgatccttactggtgaacttcagtatagaaatgtatagatgtttcctgagttatgcaattttatatcattcccatataattccatttgtttttttgccatgtgtcactaaaccattcttcatctctgctcagaactgtcacagacacaatcaaacagcataaggaccaaaaaaatttttttaagtcatcagagcagtgtttgatgtgacaatgacaaacccaaaaggagggacctttcagtttttcagctagaactatgatacctgagagaatacatctgggtaaataacaaaggaacctgataacaaaaagttgagggttcttctttaggaatcatctgtgttcattttcaaatgagtgcaagctcagtagtaaaaatgttaaaggaacatcaaattctcagatgctgttaaattagttcacttcctctagatttgtatttaaaagaaactctttacgtttctagattagaatttgctctagcattccttctgtgttataaacagaaggctgtgctaaataagggctccccctcatggttacactaacccaaccttatctgagagacaggttgaattactgtaactgggaagactggctttctggtgcctccctactgtactcttgttctttagcactttagcagccttgtctacaggaaaaggataaaggcctttgtcagtctgtttacatattaccaattctataacccataggggaaatggaaaacctcttctaatacattttgggtcgtgtagtgtgttagtatctgccaaaaattaacgtgcaaataatgtgaccttatttggaaatagggtctttgcaaatataatgcaggtaaagagtgacatcatactagatcagggtgggccctagatccaatgacagtgtcctcgcaagagacaggaaatggcatacagagatgctggagagaagagggctgtgtgaagacagaggcagagactggagcgatgctgccacaagccaaggaacaccaggagccatcagaagctgaaagaggcaaggaaagattctccccctaaaccttctgagacgctgtggccccactgacaccttggttgcagacgtctggcctccagaactgtgagagaacaaacttctcttgttcttgtttttttgttttgagacagagtctcactctgtagcccaggctggagtgcagtagcacaatctcggctcactgcaacctctgcctaccgggttcaagcaattctcctgcctcagcctcctgagtacaggaactacaggcgcatgccaccacccccagctaatttttgtatttaatagagatggggtttcaccgtgttggcgaggatggtctcgatctcttgacctcgtgatccgcccacctcggcctcccaaagtgctgggattacaggcgtgagccaccgcagcctgcccaacttctcttgttttaagtcaccaagtttgtgggaatttgttacagcagccctggggaacaatgcatgttaggacagtttgtggagaagggccatcttctgtgggcctaaagagacattattaaggtcgacataaagttctggtccagattaaagcaagccttagaatttagtcttagtggattttagacagaatttccaatgagctgttcttacgcataattgtatgtggtataaaacctcctaaagatgattttgcttcactgttcacttgcagttctgggttgtgctaaacttgaaccacatggtttttaccgggtgttttgtactcttttatgttatggtgagtcaggtatggctacaagagacaccagggaggctcagaaacacaaaagtttattattcccacaggttctagagacaggaggcagggcataccatacagggctagatgggaaagacaccaggatggtcaggaggcagaagacgggtgagaggggaggcatcaggccagagcctttattggggtttctgagggaaacacaaggcagtgcagggtgagcagcttaagatgtgctggtttgaataattttggagggctctaaacattagcagtggtccttacttcccagctacctggccctaggataatgaggaggaggactattgcctccggggtgtgtgggctaatcagaggagctctaggtctggattggttagtttgcatatcaaaggcatgctctgagcaccctttgctctctaagaactgacaagccctgggaaagacaatctcttactagcctagaaaggttttttaaaagatgttaaatatcataatatacagaaaaaatgtttaaatgtacaatataccaagtctttcttgagttcaactttgccagcacttccctccctgcctcccacttctcaaatgtacacagaaagttgcggcaacaaacaacagtaagtagagagtcacctttaccatgtagcaaaaactgccctctgcctatgaatgcttctctgggaagctccttgaaagtatgaacattttcccacgtaaagttttctatttcagctccttcccaatgtgatcttaaatgctttgccttccctccccactgcggcggactttgttgtctgttagtaatagtttactttgcaattttgccattcactgaatattttaggtttgaaaagacatcttatgttctaggtttgtctatgcatgactactttttttattattatttttgagactgagtcttgctctatcacccagactggagtgcaatggcgcgatctcagctcactgcaacctccgcctcccaggttcaagtgattctcctgcctcagtcttctgagtagctggtattacaggcacctgccaccacacctggctaatttttaatagagacagggtttcaccatgtggtccaggctgctctcgaactcctgacctcaagtgatctacccaccttggcctcccaaagtgctgggattgcaggcatgagccaccatacccagcctgtgcatgactatttgtgacactatattctaaccctcctaggaatatttggttttgtctaataagagttgtaataataaaattaatagtgtcttatatttttttagtatttattatgtttcagacatagtcctaatcctttaagcacattctctcattcctcctcactataaattagatatgatagactatttccattacacagggaaggaaaatggaagtacagagaggttacataactcttctgacatcatggtttgctcagaattcataccaaatgcttggcttgttctgttttgtttttgtttgggaggaaagaacatgcttatgatgttaatcattgtgtagtagggccttcaaacaaatctcttattgataaaatttgaattctatgaagtcttccctttaaggattttggttttaaaaaggtaaattatttttaactttctttttaaaatatataagagattagatgaacttccaaacctaaaattgcaagtataatagtatgaataatgagtagtatttttatagcagtttccattttgagtgctttatacattttacctcatttaatcctcatgacaacccaggagaaagggactgtttttgttccctttaaagatggagacattgatgcactgcatcaatttcatccaagtcatggatgtctgttttgccttgttataaaggaatagttgtggctgggtaatttatgaagaaaagaggtttatttggctcatggttctgcagactttccaaaaagcagggtaccagcatctgctcagcttctgatgagggctcaggctgcttccactcatggcagaaggcagaggggagccagtgtgtgcaaagattacatagcgagagaggaagcaagagagaggaggggaggtaccaggctctttttaagctagctctcttttgagccaatagagtgaaagagaagtcgttcaccctcaagggacagcattaatctattcatgagtgacccacattcatgatccaaactaggacccacctcccaatactcctaatactaccacattggggattacatttcagcatggggttgggtgggaacaaacagccaaactatagcagtagacatgacaatcatttcaagttctcaagtgagtgagaaatgtaaatcttcatttttctatggccaaaggtaatttctgctacaagggtccattcttccaagtggtagaagtctaaaccaaggcagttaaaggtctgattcatttcccttcacctggcattgcagttgagctcagcagtctctgtggtgccaggacattgtgtgggggttctggttgcctgttgtcagctgatgatggcagcatcccctcagatgtgcataaatccatctggtcctctgccgtaagtcaccactctgtcatctcctgcctgtcttaggctctttcacatccagtgcctctcctgcctacatctgcagcactctggggctcacaggaaacatttagtacacctgagccaggctgagcccaggagaattttcatgctcatatttaggtccatctgcctaggcccttatggccatttctcctctactattcctgtgtcaagccagagtgtgcaataattctgtgggtcctgccatacatatggcctctacttagcaaaggacaccaggctacccctgtacccagagcccagaaaccaatatgggaaatgtgtggtttcccctagattcagcccaaggaggagggaaggaagaaagacccctccactctctctggtgcaagtctcttgttaagtctgggaaaagcaaagctcagctcttctcttttttggtcttccatatctattgtcagtaatcaaatttaagcatttaaaaatcaaataccaagaaatttgactaccttattatctgtaaacttctgtctcatccctttcaggcaatgaaagtggttaattctagctgcctaggataggaaaaggagcagaaagtgcaaggaatttaagagaaggaaaactttgttaatgccccaaagtatttttcctgtcactggcttggcacttactaatccatgagaattagataagcagtacttatttatgggtgtgatggtgatgatacatattttcaaatcagattacaagaatgtttgaagtatgtcaagcagttttaaaattttcaattggtcctgtgtttaaaattctggaacattaattattccattatttcccaagtacaacttactatacagctatcagaatgatggcaatgccaggtggtttgatggagacattagcggttctcattttagaatattccactaaagttggtggtttgtcttgttttcaagttaaaaacacagaaggatacacatcacatgcctgtatcaaaatatcttatatgccccataaacatatagactgaccatgtacccataaaaattaaaaatgtaaataaaacacaggaggaaaagtgatgtgtcataaatatgtgtattaatgcacaatcatgcattgtattttcaaaattttctggttttctatttattattctcaaaataacattgcaaatacctaagtagctgaaccctaggcttttctgaaaatacagacctagctttaacctcaaatttgtttatttgtgttttatgatacttaaactatgtatggcttaccaccacaaagattttcctctcagaacacttccttctatatggcacagaaaaggtaatttgttagtggcctcaatttcctttaaaggatgcccaggataatgtcacatcctttgatttccataaacagttgcctccaaaaggtattaagaccccagaaagaggtatatgtattctgtccctcaaactgctgttgtcattaaattcaaagaaactccacacagtttgatgaattgctctgcctggccagcctgcattccagcgtttactctggtggcctagggcacctctgctcttgtgggtaataacctcattttactttatgagcaaaagatgttccactgtgttcgaagaatgagtactgaaagttgactaaatacgtgagaatcagaaatgctccactttagggccagacatggtggctcatgcctgtaatccgagcactttgggaggccgaggtgggtggatcacaaggtcaggagttcgagaccagcctggccaacatggtgaaaccccgtctctactaaagatacaaaaaattagctaggcatggtggtgcatccctgtaatcccagctactcaggaggcagaggcaggagaattgcttgaacctgggaggtggaggttgcagtgagccaagatcatgccactgcactccagcctgggcaacagggtgagactctgtctccaaaaaaaaaaaaagaaaggctccactttgcataaatacaagccttataaattaaccacttatttattaatcaataagcatgtacacttattaaactatcacatttagcctttcattttcataaatgatcataccatttaacatgacatcatcacacactctgttctggcctctgctctgacagagacataagtccctcaaccaaacatcaagggagcccaggagtgaccctgcaaatcgacaggaatgtttctgaggactacctgcatctgagccacctggggggctgtgaaagatgctgagtcctaaccccccaccccagaaatgctaatctaataagtaggagtaaagcccaggaatctgcatttttttaacaaataccacagatgactatcaaaccagtttaagttttgaaataattcatatgccaatggagacaattttattatccaattcataacacctagaaaatgattagtctaaatcagaagtttttaacgttggcagacatctaatcacttggaaggctcgttaaaacatagattgctgggctctcaggttgcagagtttctaattcggtgcatctgaagtaaggcccaagaatttgcttttctttcaagttcccaggtgatgctgctgctggtcccagatatacacttttgaaaaccactgatctagacgatctagacagtcttcttgtgcaaatgcaaaagcaaacattttcaaaatgtactaataggtgtcatatggaaagagttaaacaaaattaaagctatttctttattgcctgagttctcatttcatcataccagcatgcattattaattccaagtggggatagaggatgcagcatttcccaaacatatgttaccatagaactctcttctcaaggatattcctgagaaactatttcagaaaagcctgataaagcactgtgacaagttaatgcatccaagaaacttggaagtttcctgtccccaatcaaatctcatcctttgtcctcatcccccagtgccagtgccaggggaatctaacaacatggggggagagagatgccttctccagaattcaaattggtatgcctcacccacttttccataaaactaaattataactaatacttggtacaaatgaaataatgttcatgcattttatgtactttaaacactttatgaggactagtaagagctagatttcaatgatattaaaagtaccttatgacattttgagctggatgataaaagaaaaaaaaagataaaagtaccttagtagtcactgaggtatacaaaaatacataggtaaaaaagattttctactatactctcataaagagataaaatatatacatcaataagcatagcatgaagcagattacagtaagtataataagaccgttataagcaaaatgtccttaagttggggaccacccacattaatcttatttgagtgtcttaaactacttgatggtcgacatctagcaactttgcttaaaagcaatacactccgagtcacaggatttttctgtgactaaattctagctgtcctccaatgcaatgtgagaaggaccctagttgactatggcaaatcccataatgcagttcttccaaaacttgctttaagactaacctaggccacttatgaaaaatatagatttcccagactccatgctgaccaaataaatgagagtctccagtggagaagcctgtaaatttgtgttttggataaatgccccagctctcagtttttattttagcataagagagactgagctttctctgaagtgtctttaaggacagaaatccaatcattcattcattcaatcaacaaatatttagtaagctcatgcagcatgcaagatcagatttttcttaatctatgtttttagactttatttatagcatgactatatcatttttagctgaaaagctcttttttagtaaaaatatttgttttattggtgccatttttacaacactacccatatatactggaaaccatatcccctaacccaatattctcttctgtgcggtgcttgttccactaccctagactgcctcgagataaatcagagaataaatttcatcaggatcattactgaagtatgaaaaaccattttgatcactgccctatacatccttaaaatatgaaggacacaggatttaaaatatagaaacacatataccaaaagctgttttctttaaaatgctaactctccaactttgcaattttggcaacatttcccatgttctatatttctgctttctgccttctggtgggaggaagtaatgggtagaaagaggaaaatactttggaaaggcagaaagaaaagtaaaagcttattactaaaaggcttgtttgtttgatgatgttgctatttaatgaacacaatggtgaggacaaaggattaggaaattgcacatagcccatggttttaagcatggcattatctattaatggtaaaaaaaaaaaagaaaatcagcaaattgaaattgtctatttgtaaaagctcagttaaatacaggatctgctaaagaagccgagtgaaagaaaatcagcatctatggcagtcacccagccacctctcatgaatttcctagcagcagtgaaacattacccacaaaacagccctgtgttctgggatgctgtcacttcacctaatttccatcactgatcctgaggtaggtggatgtggcagtaacaggaacatgaacgtggtgcacagagtgaagcgaggccctggtaggctgcaaggtcgaagccttcaaaccttcacaagcccatttctcactcaccttctgcagatatgcatgaagactgtttatatgaatactcaaagcctcaacatactctggcctacctacttacatgctttatttgtaacatcgataaacatataaccactcataacactactatgtttttggtaaattgtttttagtaataccttgatttgcaatactttcattgatttcataaagaaaaataatgtgaatttaaattccagttaataacaacttctggttgttatttaaataaacttttttataattcacacaatactgatgtaagagcctcaataacagaagtgaaacagacaacagaaaaataagcagcaaatagtaatagctaaatacttaaagctgatgtcccacaaaaggtgaaattctatagatagaatgtaaacattacataaattctttggcctagaaaagaaatacaataataatttatgattttaattgtttagttatttttaataaatctgtttcttagtcaggtcacctaaccttcttcagtatcaatttttctatctgcagtatccattcttctatctgggtttctgcttatatatatctgtaagtggagatgatgataatgaccaaatgtagttatgaggataaaatggagcacctagcacaacatgatgggtacttgctaaatatgacttctttcagggctaaatgctagcattcagcctctcttaaaaggggtgaatgaaagtctctcaaagaattctccttatctaaagatatgaaacaagtttacaaaagtaaacttgccaaaaggtcaaaaaactctgcaaaactaggaaaggaagacagtccaatgccataaatttccaaaatctcaaaacctgacagccaaggaaatatatggtgattccggagcccagtagaacagaacattttgtaaggctcctgatcccatccccagaacccacgtgactcttttttttaggcaaccacaaaattaaactacactaaatttatgggttcagaaaaaatgcactgctttttcaccctcatgagattccacttgagctccccaaattaactaaatgtctaatcattgttccgccgtactttaatccaatgattcagtcagcctccccacatctgtcattgttaaatggaaaaaaccggaaactactctaggtatattagacagaaattaggtaagcagaatcttctcagaagggctggaagagtgggtgtaaacaaagttgacatccatgctgttggatccatcatggctgcgactgacaacggagacagctgctgctcccgcccccaacacagctgcctctcttgacacccacaaggctggtagtacctgaaatccccttccacaattgctcctatgtttctgttttagacagagcagcaaacaaatgaccttatacctctcttctaaccaagatacatgtgagtggatcccaaatcctggctctacaggaggtgtgaaatgttgtctgaagtttttcagtctctgctgcacaggaaaacaccaatgaagttgggtcaatctacagcatattccatgacaggttccttgcagttgtacaatacaatggctgttcctcatgatctgttccattggtgactcaacatttgtatgcatttgctcctcaattgcttttcgcctaggccagcattgggttcagatttcagtcaacaatctagcaaaactactgcttgagctaacacatggaatccagaaactccaggaggtcactgtattagtccgctctcacgctgctatgaagaaatacacgagactgagtgatttataaggaaaagaggtttaattgactcacaattccacatggcttgggaggactcaggaaacttacaatcgtgaccaaaggcacctcttcacagagcagcaggagagagaatgagtgccaaacaaagggagaagccccttataaaaccatcagatctcatgaaaactcactcactagcaggagaacagcatgggggaacacgcccccatgattcaattatctccacctggtcccacccttaacaagtgggtattattacaattcaaggtgagatttgagtgggaggacacagccaaaccatatcagatacccatatcgattagctttgcctaacctaaagctatatttctacttcctggtctaatgcttgcagaaaccattctcatgcaaattccttgggtttctgcttttataaaatagcaaaatcttttggtatgtcagtcttctctaagtccaatttgtgttctgcagcatgctgggctctggctccagttataataggttgagaagcaaagaagcctggtaatgaaagggcctgaggagagttggcaacttatttacctcaagtaaagtaactcatgtgtcttcaaacaaactacaactaacctcatcagacaggaaaggggagctgcttttgcttgcaagggaggttttgtgggaaggggatttagagtggtcatatttgactgaacacacacaaatgtcccagtgcaattcacaaggtctgtcttgccaatcagtgttctaatgttcacttaaaagatatgacagacggagcacagtggcccacacctataatctcagcactttaggaggccaaggtgggaggatcacttgaggccaggagtttcagaccagccttagcaacacagagagacccccatctctacaaaaataaaaaattagctgggcatagtggtatgcatctatagtcccagctactcaggaggctgaggtgagaggatcccttgagcccaggagtttggggctgcagtaagctatgatcacaccactgcactctaacctaggcaacagagtgagaccctgtctcaaaaaaaaatttttttaatgatatgacaaaatatgaattcaacttatactgtaacttaacaacccataggatcagattctatataatgtagggatacatcagtcctaagctaaggccacaagaaataaaagattatctgagggtagttctatcacccaggctggagtgcagtgtgcaatctcggctcactgcaacctctgccccacaagttcaagcgattctcacgcctcagcctcccgagtagctgggactacaggcatgtatcaccatggctgggtaatttttgtatttctaatgggggtttctccaccttggccagactggtctcaaaatcctgacctcaagtgatctgcctgcttcggcctcccaaagtgtggggattccaagcatgagccaccgtgcccagctgtttcctttctttaatctctccagagctatttctttagcaatcccacttcacaacccttgaaatttctcattctcattctaatgatttatcgtagcaagaactttgccagagtctagccttctaacagacacatcattccaggaagccatagcaataatttaagtgacttctttttgtcactgtgtaccattaattatgagagtcccaagttctaataataacatgattgccgttatctgtaagaagaatcggaatagataacccatccgatgtttccatccttgagatgtctgagagtctgttatctgtaaccccttctggaaggaggaaacagaaaccactctagatatttttgggaaagagaagcttaagaaaaaaatatattttatacaggaaaaatgtgtttgtagaatcattttaaaggctgcggaaggagtcagaggtagggaatacaccactgtatagttgcaagcccaagatcaagaagcatttgcttctgtcacaactgctactgctaatcatctctacatccatgaaactgggaccctgaggctggctgcagtaactgccctaactgccactagatatccatgaggctggtgtgtataaacctcaggtctcacaagagtgcgtccaattggtagaagcttatctataacaagaatcctggctacttagggtctggaaaacatatatttaagttaccaacttctgaagaatacgaaagcattctaaagtgggggtagaataaaagaggagcaaacattcacaaaagccaccacagtctcaggaagttttagtctctatttggctatatatgccgactctttcaaatttccttctcctactcctgtttctctgcctaacatatcaactgatgcatgtgttaagagttgggcaggcaccttgaacttgttcctgggtgttcaggggctggtatttgctggtttctggggcactgtcccttgtccacgaagttactgatggccttctagagtcccatacagaagtctgcagtggctcacgcctaataatcccagcacttttcgaggccaaagcaggtagatcacctcacccgagaagttcaagaccagcctgggcaacatagcaaaaccccatctctacaaaaaaaaaaaaaaaaaattagtcgtggtggtgcacccctataatcccagctactcaggagcctgagggaggaggatcacttgagcccaagagggagaggttgcagtgagctgagattgcaccactgcattccagcctcagtgacagagcaagacgctgtctcaaaaaacttttttaattttaaaaattttaaaagaaatcaatgctagacttaatactaacttacagaaataggacaaacttttataacttcactctctgttcatatgtttgggcatccttagggagtcctggtagcattcaggaaaaaatttagaaggtctagagaagatcacataccaacccctaccaagagaatgaaggcttgtaccatgtgcagagatccccagagaaactgcttcttcatccctgttcactagtccactctatcacttgcttgactgcactgtctcttatgtttcaaagtaactaaaagatcattaggaattttgtgagaaaagcttcttccttttatcccacaaataaaatcttctatttttttaaaagtgacataggggtttaaaatagaaataagaaaatatagaaatatatatataagcactcagagaataatcactttagataccatggtgcctttcaaaaaagaaaaagagaaaagaaattagatcatgccagtcatgttttctttctttcttaaaagttaatcggccaggcatggtggcttacacctgtaatcccagcactctggggggccgaggctggtggatcacctgaggtcaggagttccagaccagcctggccaacatggtgaaaccccgtctctactagaaatacaaaaatttgctaggcgtggtggcgggtgcctggaatcctagctactcgggaggctgaggcaggagaatcacttgagcctaggacacagaggttgcagtgagccaagatagtgccattgccctccagcctgggctacgggagcaaaactccatctcaaaaataaataaataaagtaacataaaaaaagttaataatcatggctgtctagccatgtttatacatctccaacatcagttttagagattgaagaagatgtagggaaacataattattgtaaaatactaagaacagtgtgccatatttggatatgtctaaaatactgcttcttaaaacgtcaaaatattacttacttcaggaacacctatagtgcttgttaaaaacagagaatagtcagggcatggtggcgcacgcctgtaatcccaacactttggggggccgaggcggacagatttgaagccaggagttagagaccagcctggccaacatagtgaaaccccatctctactaaaaaaaaaaaaattaaccagatgtggtgtcaagttcccgtagtcccagctacttgggaggctgaggcaggagaatcacttgaacaagggaggtggaggttgcagtgagctgagatcgtgccacagcactccacctgggcgaccaggcgagactctgtctcaaaaaaaaaaaaacaaaaacaaacaaaaaaaactggagaatggttttttcataattcactcccccaaaatgtttttaatcgaaataattaaattaaatttaaaatggtgactagggagcccatctcagactataaaatgagaatctccaggtgggggtccataaattcacgtttatagcaagtttccagataatgtttatctcgctacatttggagaaaccactggactgttttaaagagaggacctgtctccccacaatataccagaatatctctgttccttgaacttttttgttctctgatttttattttaggagacaacaatggatggtctctgcaatttgacaaatattttgccagttactacaaaatgacttcccaatatccttttgaggcagaaacacctgaatgttgtaagtaatcagagcagttattttcttttccatgagttcataagacaccatttttaaaagtttgattcaacattttaaaaaaagattgcatctcaatctggaaatcagttttaattaaagaaacttaaaaattcgtaagaggtcaattatagttttctaattgcaaattctattaaatatacaactttaactaggaaaatttatttcaaaaaagactcagggatcttaagtgtagaagtaataaatggtgtcagatattgttatgaacagaatcaatgtcagtcaaggatgttattttatatgacttctcttttcacaatcactataaagtgtgatgtaaagaaaacagagaaagtagagagggcagaaaagctgtttggattttaatgtttgctagaaaaaattcttctgagctgcaaaacccttattcattataacccactatgttcagtcatacactgaaaacttacaaaaacactggaggggtatggaaggtataaacctgaggattaactataatattttagatcagaaagatatatgaaaataactcctcttaaataaattttgtcagttctaatacattatgcaaatgtaaatctgtatcttggagctgtcattttgaccctagcttttcaaaaccttggtttaaaagcaaggcatatttgctattcctctgacattccagacatggttccatatcacagcctctatacagactgttctttgagaaactttctcccatgtatctgcttagttggtgaccctcagcttattcagggccctgttcaaatcaaagaagactgcagtgataacgctgtataaaacagccgcgtcctcagccctaccctcattactctatgagcttactctgtgttattttctggggtggcactatcataattgctggtggtagtggtgctggttgtggtggtgtatgaattatctcatcagatcctaagcactatgacaatgactatgacaataggtactttgtttgacttttttttttttgctgatcttctagtgcctaaaataaatagtgctttgcacatagtgagcactcaataaattattgttgaagtctatataggaggctatagataggatgttttgttttatttttcatctttgtatctgcccagaaacatacatatttaatgggttaattatggttacagtaaaacccagttgaatttttttaagcccagttgaataagtatattttaaacatgtattttttataataatttttcttatagctaaaacttttagttttttagctaacaataaaaacattcacagaattctttgctgggtttttaattcatggtttatttttatccttttttgattctgaagcatgccagattaacaatatgtctgaataattgaggctttatttatgtaaatgttatataataataactacattttaataacaaatgcttaggtggttattttataacattatttttctaaggttgcattatcctaaattatgtctttagtcgtagatataagcacaatgtattatgtaggcaatgatttaactattgtagagttcaattatttaaaagagtaaaattttacactatgagttctagaaaatacatgtttatacatagagccacagtttaccttttgctagtcctagtaaatgctaattattcaattctcttactcatcatcacgttttctattctctccgttttgtacaacttatatcactcccaccttcccaaaacattatctgggcagctttgaatggaaaacagtcatgaatgagcaatcaatggctattcactacaaaatggtggagaggtgactaagagtttattttagacaaattttatatcatatatttagtttcttcatgtcacctggcaatgccagctcctcctctgttctttttttcctatatagtgccttcctggtcatatccttttcgtaaaaccatttaagatgaataggtaatggccacatattaaatactagtgttatgaattagtagatcaacaaaatatgaaatattaaaatgtaaggattgcctatctgttgcaaatataaagttttttctcttgcaaaaattatttttaaaaaagcaaggcatagaggaagaaatcctttgctatatttttttcttcatgttctaccataaattgtaaagtctagctttttaaatttttaatattttttatcttcactactcaaatgaggttaatcaaataccactaacaatctccagtttaaggggatagacgtcactcttgtgagattcacagggtactcagcaatctgtctcagcatcatgccattatttagagggagaccaaataatttgtccattaaaaagctaaaaattggctgggcacagtggctcacacttataatcccagcactttgcgaggctgaggtaggaagatctcacttgagaccaggagttcaagaccagcctgggcaacatagtgagaacccaatctctccaaaaaaaaaaaaaaaattaaaacttagctgtgctactcaggagcccaggagattgaagctgcagtgagctgtgattgagccactgtgctccagcctaggcaacagaacaaaaccctctctcagaggcagaaaaaaaaacagctaaaagtttttgggaaaggaaaacgttaatagatataatttaactgataatataatgtttaaaataatgaattaagccatgttgtctcaaaacagtttttttcttttatcatatattgttttctttttatttcttaatttttttttttttttgagatggaatttcactcttgttgcccagactggagtgcaatggcgcaatcttggctcactgcaacctctgcctcccaggttcaagtgattcttctgcctcagcctcccgagtttggattacagacatgtgccaccacgcctggctaattatgtatttttagtagaaacgagatttctccacgttggtcaggctggtcttgaactcccaacctcaggtgatccacccgcctcagcctcccgaagtgctgggattacaggcatgagccactgcgcctggtctatttcttaaattttaattgaatcttttaatacctcaccttattcccaaaaggattttcagcaacttacaattaaaatacagctactaaaagccttaaaccattcacatgatataaaagacaaaagttcagtggtgagtggaaagcgaatgacaaagaaaaattaagaaaatccttcctgagaaaagttcagtgacttcatccgaagcctagttatgaatttcatagctgtcaagtccaagagagaaaataatgggttacataactttcatagtttgtaaagcaaaacaaacaaatggggaaaaaccaggtaagtcagcaagagaaatatatttttgcgtgatcctgcaccctggaagacatttgtcacaagtataattacataaaaggaatgaggctatgtaataaatgctgtattaaaaaaaagtaatttttttcatcagtacttaacaaaaacaaatatatcattgagagttaaagacaatttgtggggggtagtgcagctaacgactaaatatatgtttcaaacttgaaaacagtgtaaaaatagaatggcaagtgtagtgtaaaacttggggttaaaatttaagttaaggttcctagtgtcccaccttatttaaagcagattattatagggatttattggaaattaaactgagcaaagcttataatcatttttgactagaataatgtgaggaattcacattattaaagtcatctctcaagggcaatataatggaaaatataatatctatcatgagccaataaattaacaaaatttaagtttaaaggatttgaaaagtacagagatttggaaagaattacttacttaaccataatttgaccattcagaagctaccagcattaacttgctactgcattactcgtctttttttattttaacatagttgaaatttcctatacaaaccatttttatcaaattttcaattagcatttcggcataatcaggtatccatattactacaacatcttttaaaatattccatgtaatagtatattttgtaagtgacataatttccttaatcattccttggctgttggatatttatgtgttgttttttcatttttccctattgcagataaccctgtaatcaacatatatgaattatcttaatttagtctctgtatatgaaaaaaacacactgggattaacgctaatttcactgccctccgtttctgcccttcctacttcattctcaggacctttcttccttcccaaccttttccatcccatccccacagcatacacacagactcacatatgagatatgattgtaacttaaagagacagcatcagttttcagacatccacaaccaaagtgggtacttgcaactataaaactgttgtaaagttcttggcagatactctgtttatattaaacactaaatctaggttatggtcctgatctcttgtaaccctgtgaagacgtctctggagatatttgggaggagaggaagaacacatgtcaccccatatctgagccaaaaagctcctcatgaacagtcattcacagaggtctctgcttagccactgagacacttgcttgctctctgcaagtttcaccataaaggtcagaaactggaagcctacaagcagaaaactctcatagacggttttgtttgtccaataatatttttaaatgttttcagttagctaatatcagtttttaaatagatagttatatataaaacattgtatttatggcttctttgaggaagttggtagatgtagctacacatgttcctattctaatatggcaacagatgagagaagctgttgcacttggacatctggacacagtctacagtgacattgcctgaccgctggagacactggagtctgtaacccctgctgtataggttagggctccagaagtcaatatggggagaaaacgtttctcattgctctcaggaattcgccattccccatcagagcaggaatcaaactatatttattatcctaaataataatctcattattctgtttagctatatgaatacatcattgcaaatctctaatagactttagatgtattgactcacatcctaacactatcgctacagctccacaagatggccaaggtcatacacctcattctccctctctttccaacaccaaacaccagtgaaaatagaatcctatgcagaaaaaacattcactcccataaataaacttttattcatcctttacccctatttaagccaaaagattttttaaaaaattatttgaagaactcctgattttaaaaaaaaaactatagacactatcatttgcctttagttctcctcgttcttgctagttaaaagtgatttattcctcctttaaaggttttgattatactaaatactttatttttaagtggcagttgtagtatgaacattaagcctcatcacacactatcgtgtcaatccttagcagactgttctccattcattgcaaaatgaatgaaataagagcagattatttcattcattttgcaatgaatggagaacagtctgctttttttaaaaaaatacatgagctagtgtgtgtttccaaatgttgatgctctaccatcattttaaggttaaattaaaagcaaactttggagccttaatttaaagcattgcctaaattgcctacgtagcacatgatatgcttttgtactaaatgattttctcatagcttttcatttctttcttttcattaccctcctcttcctggtccctcactgtcatcatgccttaccacttccccttgattcagtggtcggttctgtgccagtgcaatgtctttgccaaggtctggagcttgactgtgatgaaaccaatttacgagctgttccatcggtttcttcaaatgtgactgcaatgtaagtagaaaagaattacttcatcctgacagctgggtagcacctgtaaaattgtattataattaagaccatgtgattattcataatatatttttattcaaagatgatgtcatttttcctgggtcaggtataataattactgatatttattttgcatttattaaatgctagaccccaccttaaattattctttatattaacccctcataataatcctgcaaggtatggagtgtcaccatattttatctaaacaaaaaaagtcatcaattgcatgtgctactaagaaaaaatggcttctaattaaactattacatagagctttcctattatatagaattttcacttgacatttattgaaagaactctgttagaatttattggacccaaattttaatataatctgatgtgtaagttaaaaaagaaaataaggtaaattggataagatattcctcccaaaacgtcatatttaaaatctgttctgaatcacattttgagtcatagatgttaatgttgttattttcttaaggaattcaaacttacatatgtaaaaaaattatcaccataagtggtttgttgatttctagtacccgtaatgttagtttccagtactaatttgaattcaatgaacttcagcaacacaaacatatacatttgactgaaacttttttaaaagaaattagtggaggacagctattttaatccaatatttttgctgagtttcttttttcatttagataccttagtgccttgtggctctcacttttgggtatatgaggacaaaataagagtaattcttgagtttatgcatattgacaagtgttaccgttttcaaaccaaaccacataatacagcaattgaaatacttggtatatgaggtaagagctacaactcagagttcctgtgcatagtggttccattgaattcacagatctgagaagtttacccaatttgtggtggccagggaatatgaactgaaaatatcagcagagttttccaaaagagggaacatttccacttgaactaaggaaaagaagagctcttcagcattctatcctcttcttgccttaccatggctctttctcatagcaattagtcctgctagaaaaaagtaataattccccaaaagaacctgaggtcctatggagcacttctctgatttaaattctaactggaaattctgagtataagaatttatgaatagtctgggcaacacagagagagcccatcactacaaaaaaaaataaaaattagccaggtatgatggcccacacctgtagtctcagctacttggaggctgaggcaaggggatcacttgagcctgggaggtcaaggctgcagtgagctatgatcaagccactgcactccagcctggatgacaaagtgagaccctgcctcaaaaaaaaaaaagaatttatgatttcattctattttcagagaaaaaaatcataatccttctccactgcttgtatcaaattactagaaaatccaaatcaaaggatattctgatgcagccaatttcatttttcattttcccacgagtaagatttgaatccattctttaacaattcaaccaacatttgtaaaataaagaacagagagagaaagctgggggaatggaggggaataaggcaatggctaactagagagggcatgccccacacaaaggttgaatcattgaattaattcccattcaattttaaaaattgtcatgatctagtatacacatacatacgtacataaagagatgtgggcagaaagctgtgacctaccagttttcaacccctggtataaacaaaaaaactgggaccaggtccttgtaaatgattgtctgcaagaaggcaagaaagaaggagtcagagatgactccaaggtttcccttctaagcaacagtatgatcggagaatgaggagacttggtggcagtaactgaggaagatggggactctgatgttagatgttttttccaatgtgagattaacaggtcactcagtggaaatcttcaacaggcatttggagatataggaataaagctcaggagtttatgtctacggtattttttattttttgttcaaaaaatagcattatcttgtgctttaggttgagccacttgattccagttgtccatttatacttttctctgcagaacactggcttagactcatacgtagtcccagtctgttcagttccatacagaaaaagaactctatgctttatagcacatacattaaaaagtaaacatcaaatttcattagtcagttctttccagactttgagttggaactattacagggaaatgtcagaagaggactgaaccatatgtaagtatcaaagaagctaatactccaagtaatgtttattgaagttgggatttttttaagacatttcgcataaatgctaatgaacaaaacaggcaaacatagatagatatgattatttttacttttttctagcttgataaacactgattttgactatttgagacttggctttaagatcctggaatttaatcactagaactatatgatctaatactaagaactttctttataaaaactagagctagctttgacaataatgattaaactaggccatttctctctcacacacatacaaacacaaaccctctttgactctgtgaacaatcaaagttggactgtcaaattttaaaatataaggatttgttatattatattttgggttgttctattcaatgagaataacagcatctacctctttctatcccaataggatattgtgaaatgtagagaatgttatttgtcaaaatattttatgtcatttagaaagaagtaacctataaatcctagacactattaataaaaacccaactttttaagtaacattacttagaggtctttcaatgagcctcactttcctctatagtaactctcctccttcaagtgcagttaacctcttcctcttgggttctctcgtagaacctcacttgtgtctcttttatgtatactaaacattcttgcttgtgctatagtgattcaggtcctgttatctacctgaaaaaggaaaatgccatggcctatatatcctccaaagttcctaatagagtctaataatccctaaataaatgttattgaaatgaatttataaataaatacaaaaaaaaaaagaagttggttgcctcattagccccgggctgttaagactgaagttattattcaaagaaaattctctatttatagataaagtataatttgtgcaaatagagtataaacttcttaaaggcaggtatccaacatgtgcaaatggcaggcattcaacacattttttgagataatgaatgaatgaatgaacaattttttttttttgagacagagtctcactctgtcgcccaggctagagcgcagtggcgcgatcttggctcactgcaacctctgtctcccaggttcaagcgattctcagaacacatttttaaggacacactaaactttcatctatatccttaaatcaaactcaggtttttttgtttgtttgttttttgtaaacagacagggtctcactgtgccccccaggctggagtgcagtggtgcaatcacagctcactgcagccttgacctctgaggctcaggtgatcctcctgccttagcctcccaagtagttgagactactggcatgcaccaccatgcccagctaatttttttaattgtttgtagagatggcggtgggggggcagtctcactatgttgccaagctggtcttgaactcctgggctcaagtgatcctcacaccttggtctcccaaagtactggaattataggtgtgatccactgcacccagccaaatccaaatatttaacaatttatcttgacacaatataaacatttaaacaggatataagcagaatttagaatctaagtcaagtcagaatcattagcagaaaagagctcctcaattagttaatatatacaaggaaataatatttggtgacagccagcaactgagagtagtttcaaaagggaattacttgttaatcagcctttggtattatttatgtaaaaagccattaagtgtctgatatgtgtagtctagaaaagtgatttttaactttttttctttcattattgtttcccttcccccagggagactttttagacttttttttttctatttgtcccctcctgtgaaattttaatactacagatatacggacaggcgcagtggctcacgcctgtaatcccagcactttcggaggccgaggcaggtggatcacaaggtcaggagttcgagaccagcctgaccaacatggtgaaaccccatctgtactcaaaatttaaaaattagccaagcgtggtggcgcacgcctgtaatcccagctactcaggaggctgaggcaggagaatcgcttgaacccaggaggcagaggttgcagtgagccgagatcatgtcactgcactcctgcctgggccacagagtaagactccatctcaataataataataataataataataataataataataatacagatatactatatatgttcttgtgtatatctgcattatacatttaaaaagtaagattttttttttcttaagaaccaattctcaccttcattgagagtgcatggacttctagactctagaacagtgtttctcaaattagattccaaaaatgtgttccaaagagtccaagaaagttttttttaagaaggattcatcaccaagtttaagcaacaccacttcaaaacctaaacattgttagtgcttattgtataaaactgtcttaacctgagttaagttaacctccagacaatgcggtctgttgctcacttataagtatccgctccgtggtactatataatgatagtactaataatatcatattattagataccatctaatccaaatccctcctttcactgttaaagagactgacttggagaggttgtgtgtgattcatgcaaggatccccagctacactggttttggtttttttattgtttcatttattttgcttttactacattacattgctgttctaaaacaaaaaattaaggacttgggacctttccagtacaaccaaaattatgtggatctggtctgtgtcaaactgcttattaaattgtgatacaaaagaaaatcttcctgtacaacttcttagaagttgaaatggaatcacttattgaataaagatgatccaattataggtaccaattgatgttttccttcataactaattttaaggtggtggaatgtgagcaatgaaatattgagaaatacaatatttaatttcttgagtgtttttaaacagaaaatactgtttttattgtcacttagaaactgagatgccttctaatgtttgttaaatacaaataggaaagaaaaacataactgaaaatcaattttttcaattttattttttaacattttttgtcagaattacagtcataaccaaaattttaaaaaaatgaatagctttaatagtgcaaaactaacagctagacctagttcaagtgatatgataaatatgagagagacattatgaagcaaaatgtttcctgaaagctagtactaaagtaaatagtttgtaattatccctattgttgtaatttaaaagtaaaggaaaaacaactttaagaatcaaaatttacatttatttcaggtcacttcagtggaacttaataagaaagcttcctcctgattgcttcaagaattatcatgatcttcagaagctgtaagaaaatacttaattcctggtattacaattaactagcatttttggccatgtctttttcttcctacttctgtgaacaccaacactattccgctgcttgtgtctaatccctattcagggaaatatttagctgttaactgaagacttccaggtaacacttattttttctgagtaattttagaaaccattctagaaaaacctcagacacatatttccaaaggaactggaacatgtgtgctgtgaatcctcctaccacaatcccccaaaacggagatacttagaagcttttatcctctgcgttattctagcatggaatacctcaatgctcatcttagagaaaaatgttacgctcttttgtcagattcacgatgaagaaagtgaagaattttcttccatgtgttttcaaattcattatccacctaaaatagcaagtcactgtgggttgaaacctctgagcatgttgtcttggagacttgattccattttcacatctgccttgtgagttgcgttttattttggccttgagtagtatctgacatgctagcttcccttcagaactctcaaaatccatactggcccacgggatgtttacctgttatttaggtctactttgtgactaaattatgttgtcatatggtgaattgctgggtttagatagtctgtacctaaatcacactaactaagaaatatctcaggattcattgtttcatttttataccaatatagattggttcttattttggttttacaatagggaaacctgataaattaatatatatctgtacatttttaaagataacagatggaaattgagtggaatcagaagaagaattaacccacttccttcagtgaaatgttctaaaaacccagatagtctgcagaagtatctatttcatatttgaaaatagaaattctaatgaaaataacttttcaaaatttcattctgaacatttatcagtcaaaagagaagaacttttcacaattaggcctgacaaaacttcaagagtacactgacttattctattttctgatttctggagactgaagaatttttctgtagcatcaccttgtgtccacttatttaaaggagctagactacaaatctaaatatcaaaattcaggtttatataatgcagtggcttagcatttttgcacaataaacattgaattaattctcttttttgaactaaccaccatactaatgtggatgaattaattcctgaatgaccaatttgttccatataacaaaatgatcaaaatagcctaattatttaaaaatttctaattggttattaaaagtctatacctttagacctccaggcaatgcagcctattccttagtagatcattataacactagaaataaacaaacaaatgcatgataaatgagaaccattcattacctactacatgattgggcccacagcatgtccggttcaggtgcataataatttttttttaagagacagggtctcactctgtcactcatgctggagtgcagtagtatgatcatagttcattgcaccctcaaactcctggacttaagtgatcctcccacctcagactcccaggtagctaggactacaggcatgtgccaccacacctggctccttttttttttttttttagagagataggatctcactatgttgccctgcctggctggtctgtttcaaatgatcctcctgccttggcctcccaaagctctgcaattatgggcataacccacttcacccagcctataataaattttataataacatttcacaatcaaagttaggttttcttgcatgttggagaaatagggtacttttcagtcaaaatttataatttaactgaatgttcgctcatattgatttctttcttattgctcctaaaagttataacaaattgcatataaactttcaggacactctaaagaacaatggtgacctgcactcagaacatgaaggcagccttgaaatccttactttatcattcccgcaatctggggcaagtacacatagaagtgcaaaactttgtgtgggtgcaatgatgcaatagcgtatactctggtacccatttcctttgacctccagttaactcaaggtcgtattttcagtattactttagttaactatgtaagcctgcattcttgtcttgacattccaatctaatttatattcttctagtcctgattatttttatgttttttttcttttgccacttttactccttataaatttcctccaaacagtctttggaacaaggtttggatgtcaaattaatgagatcaaaattgatttggttgacagatttgtgattaacatagaatatggtttgggacattaaaaacatcatacacttttaggttggctagcactgtgttgagcacttaacaagtttaaagaattataacaagacccgtattaaaagtctggcttctagacttctgatttatgagggctttactatgtgttaacattttatttctagaaaattcaaatagtaagctttggctgttattcattcatctttataactagaatttctaaatacaaaccagcctaattgtacataaatttaacagaaacatgaagtgacatgatatctggcttcactaaattattttgtaatgtttacctttttcaatttttaaaatgtttaatcgtcatcaaatacacataacataaaatgtggcatcttaaccatttttaagtctaccttcagaggcattaagcacattcatattgctatgctaccatcaccatcatccatccacagaattctttttgtcttgcaaaagtgaaactctgcttcatttttttttctttttaataatcattttcacaggtacctgcaaaacaataagattacatccatctccatctatgctttcagaggactgaatagccttactaaactgtaagtaccagtgtgaattaatttgcccattccatggtagtctgacagcctagactattccaatccagaccagcctccctgtccatgacagtaccaaggagccatgcaagtgatgctgaaggggcagtagagcaccgtggctaagagcataggattgtgagttagacaggcttcagtccaagtcctgattgccttacttactaggtgtgtgatcttgagcaatttgtattcctttcttttttttttttttttttttttttttttgagacagagtctctctgtcacccagactgcagtgcagtggcgcaatctcagctcactgcagcctccgccttccaggttcaagcaattctctgcctcagcctcccgaatagctccagcatccagcatgagccatagaccaagaccctgtctctgacaaagaaaaaaaaaaagcctgatgatgatatttgtgatgaagaagaaaaaacccaaagacttccccagttattcaattactctttcttcactaatcccacttttacaaatgcatgaaatactgtaaggttaaagaaataaagctttttgtggtaaaatatacataagctaaaattcaccatttaactgtttttaagtaaaccattcagtggcattaagtacattgacattgttatggaaccatcatcaccatccacctccaaaactttttcatcttccccaactgaaactccatatttgttgaataataattcctcatatctgtctctcccaatttccccctctccccagcccctggcaaccatcattctactttctgtatttattaattggctactttaagtacctcatataaggagaatcataaaatatgtagttttttgtgtctggtttatttcacttagcacaatgtctttaatgttcacgtgttgtagcatgtgtcagaatttccttttttagggctgaataatagtccattgtatttatgtaccacattttgtttaactgtttatctgtcagtggacatttgggttgtttccaccttttggctgttgtgaataatgttgccatcaacacagggatacaaatatctgtttgggtccccactttcactttcacttcttctgggtatataccaagaattggaattgctaaatcagatggtaattctttgatttttgagggactgtcatttgatttgattttgattttttaagggactgccatactattttccacagcaactgtaccattttactttccaactagtgttgcacaagagttccgatttctccacatcctcaccaacgtttgtgttctcgtttcatttgtttgttttgacaataactatcctaatgggtgtgaatggtatctcattgtgcttcttttaaaaaaaaaggctttctcaatgttccgttttattgagttctgccatgcagcattctagaagtaactggaaagaagtataaccaaaaatcacatgaatacataactccctgtatttccatttatgtccccttgttttccacctatactgttctgtatcctaacgcaagaaacccattccagtcagatttttggcttgtggtatcagagtttgggattgagtcgagaagagcacctagtaatttactagcaaaatggaagaagactgcaggagactcgaagccttaacagtaaccactttagccatgtcctctccccttctaccccatctctgctcttttatgtcttagcaaagtacccagaatcaatattggactcactcttcaggctcctgactgtcttctttccatatatctttgcaaaatttactaaacactatctgtttggtttaatgttcagtgaatgtggaggaagctcttgaaaggcagtacagaactggagagtaaacttaaaagtgtcctccctctcttttcatagcttttctatagtgctggagtgttgttgagtgttaaagatgccacatatttctagttaaataatcattagtcccagcactttgggaggctgaggtggaaggatcacgaggtcaggagatggagaccatcctggctaacacagtgaaaccctgtctctactaaaaatacaaaaaattagccgggcatggtggcacacgcctgtagtcccagctactcaggagggtgaggcaagagaatcgcttgaacctggggggcggaggttgcagtgagccgagatcgcgccactgcactccagcctgggcatcagagtgagactccatctcaaaaaatgataataataatcattagatacctgatgatttatggatctaaacaatgattagatccataagtattcattaaccctcacagagtgcacatattttagttagataccatgagggcatagaaagataactcaggctggctccctttaagtagttataccttagcgtttcaggtagagcactgagctatcactggggagaggcaggactcctgttctctagaagtttatgatctaagatgggaaaacaatgccaacatatataaaacattagagaaccattttttaaaagtacttaagttccaaacctgtgttgctgaaaccaaaattgctattatggttcactgaaaggagtgattatctcaggtccagagcagtaaaggatggctctgaaaaatgaagaggactgggcaaaacaggtgagcatagggagcaatagtggatcaaatgtcttttacctggagggtttttgtataagagaacaccctgaggttgtaagtcatttcttaccccttactgtgcccacctgggctccaggtttgcaaaggagggaaggaagaggctctatcatggggtgccattgctcactagccctgagcaaaagtcaaacccagcaagggagaacagattcctggcaggagaaattctacaggatgtttactcaagatatgaaagactgaagaagagagagaaatcagtgtgaatcttgtattagtggaagtgaaacttgaactcttacttgcatatgaatcataagcagaaagaaaaaggaaagagggaagaaactggagtaagaggcgtgagcagagacactgctataaaacataatatgtactgaatgtttatggcatgcattgcctctattaaaccataggaagtagatcctgatactatccccattttagagttggggaagctgaggcttacaggaattcactgcttgctcaaagtcactgttaataagtagaggagtcaggaatcaaactgttcgatagcagatttagtgcagtgaattgctacactagagagattgagacatgagtgaacatggcaagaagaggagatcaacacaatagaacaaagagttatttcactttgcagaggagtgggatgtaaagatgggtaaggcagagtcaaaccctttagcaagggatgcaatgcccttttgtccataacaggcccctgcctgcctcctaggtttatctcctgtctctccttatagccccttcatggtgaggccccattgaattacctggtgatttcttaacttgtcagactctcatacctcttgcttttgcataagctatttcctctgcctagaatagctcctgcctgttctttgctttgtgaattgcatgtcttcatccaagactcttctcaattgtgcctctgtttagtaaagccttctcctggctcctcattcctccacactctgcagtccctacccctagcaaagctgggtgctttctcctctgcaatggcagagcaaccatgcattatatacttccctctgcttccctgacattacaaagtaatctgttcacatgctgtggcctctccagactcaaagccccttaaagaaagggatggcatgcttagcacagtgccatggggtaagtattcaaaataggttaatgaatacatgaatagatgaatgaatagattgattaattaattatggggaaatttaaaactaggtatgataaggtaagtggtagcaattcttagagattcaaaggcagggaagtggcatgatgagaatgctatgtaaaaaatttaagatggatgattattgtttttacttttcttattgtaagacatcaaaaatatacaaatttattgtagttatttctccttttccaggtatctcagtcataacagaataaccttcctgaagccgggtgtttttgaagatcttcacagactagaatggctgtatgtttaatttatgtggcattttattgcactagtttttagattctagagatatataaatgaattaatttttttcttctggctgtcaggataattgaagataatcacctcagtcgaatttccccaccaacattttatggactaaattctcttattctcttgtaagtactaaactaaagcaaatatttcaatcaaaggcaaagacatgaataaaaattaatgcttaaatttaataccattaaatttggatttgttaaaaccccaaagaggccttttcaatgaaaaaccttttcttaatcatattctataaggctatttatagttccaacaattttaaaagattttctgtcttctagaatatcagcccataaaaactgaatacattctcactcatattttatcacaatattcttttttttttttttttgacatggagtctcactgtatcgcccaggctggagtgcagtggcgtgaccttggctcaccacaacccccgcctcctgggttcaagccattctcctggctcagcctcccaagtagctgggattacaggtgtgtgccatcacgcccagctaacttttgtattttgagtagagacggggtttcaccatgttggccaggctggtctggaactcctgacttcatgatccacccatcttggcctcccaaagtgctgggattaaggcgtgagccaccacgcccagcctttatcacaatattcttaagcacatcgttactgtctatacaggcagacctcagtgatattgtgggtgttgttccagaccactgtaataaagcaaatgtcacaataaagcaagtcacacaaatttttttggtttcccagtgcacataataaagttatgtttacactatactatattcaattaagtgtgcaataacattatgtttaaaaatgtgcataccttaattttaaaactctttattgctaaaaagagctaacaatcatctgagttttcagcgagtcataatctttttgctggtgaagggtctcatgtcaatgttgacagctgctgactaaccacagtagtggttgctgaagcctggggtggctgtggcaatttcttaaaataagataacaatgaggtttgctacattgattgacttttaatttcatgaaagatttctctatggtatgcaatgctatttgctagcattttacccacaagagaatttctttcaaaattgaagtcaatactctcaaatcctcccaatgctttatcaaataagtttatgtaatattctaaatactttgttgtcatttcaacagtgtttacagcatctttaccaggagtagattccatctcaagaagccactttctttgttcatccataagaagcaactcctcatctgttcaagttttatcatgagattgcagcaattcagtcacctcttcaggctccacttctaattctagttctcttgctatttctacttcttctacagttacttcttccactgaagtcttgaacccttcaaagtcacccatgagggttggagtcaacttcttccaaactcctgttaatgtgaatattttgaccttgttttcatgaatcacaaatgttcttaatggcatctagaatggtgaatgctttctagaaggtttttaattgactttgcccaaatcgtcagaggaatcactatctgtggcatcagtagccttacaaaatgtacatcttaaataataagacttgaaagttaaaattagcttttgatccatgggctgtagaatggatgtcgtgttagcaggcatgaaaacaacatgaatctccttgtagatctccactggatctcttgggtgaccaggtgcattgccagtgagcagtgtatcttgaaaggaaatcttttttttctgagcagtaggtcccaagagtgggcttaaaatgtttagtaaaccatgctgtaaacagatgtgctgtcacccaggctttgttgttccattgatggagcacaggcagagtagatttagcgtaattcttgagggccctaggatttttggaacagtaaatgagcgttgacttccacttaaagtcaccagctgcatttgcctccaacaagacagtcagcttgtcctttgaagctttgaagccaggtattgacttctcctctctagctatgaaagtcttgtatggaatattttttcaatagaaggttgtttcatctacattgaaaatctgttgtttagtggaaccaccttcatgaatgatcttagctagatcttctggataacttgccgcagcttctctattagtacttcctgcttcactttgtaattttctgttatagagacagcttctttcctttccttatgaatcaacatctgctagctttaaacttttattctgcagctccttcacctctctcagccttcatagaatgaagcagagttaggccttgctctggattaggctttggcttaaaggaatgatgtggctggtttaatcttctatccagaccactaaaactttttccatcagcaataaggctgtcttactttcctatcatttgtgtgttcattggagtagcacttctaatttccttcaagaattgtccttagcattcacaattcggctaactggtgcatgaggcctggttttttgacttatctcagctttcaaaatgccttccttactatgtttaatcatttctagcttttgatttaaggtgaggaggtatgcgagcagtatatcttgaaagaaaacctttttttttctgagaagtaggtctcaagagtgggtttaaaatatttagttaaccatgctgtaaacagatgtgctgtcattcagactttgttgttccattgtagagcacaggcagagtagatttaacataattcttgagggcccataattcttgtgggactcttcctttcatttgaacacttagaagccattgtaaggtcattaattggcttaatttcaatattgttgtgtttcagggaataaaaaggcctgaggagagagatatgggggaatggctggttggtggagtagtcagaacacacacaacatttattgattaagatagctgtcttggctgggtggggtggctcatgcctgtaatcctagcactttgggatgccaaggcgggcagatcatctgaggtcaggagttcaagaccagcctgaccaacatgctgaaactccatctctactaaaaatagaaaattagctgggtgtggtggcacatgcctatatccccaggtacttgggaagctgaggcaggagaatcgcttgaacctgggaggtggaggttgcagtgagccgagattgcaccattgcactccagcctgggcaacaagagtgaaactttgtctcaaaaaaaaaaaaagattgctgtcttctatgggcatggtttgtgacaccacaaaactactgcgatagtaacatcaaagatcactgatcacagatcaccacaaacaatataataataaaaagtttgatggctgggcagggtggctcacgtctgtaatctcatgctttgggagattgaggagagaggatagcttgcagccaggagtttgagaccagcctgggcaatatagcaagaccccatctctaccaaaaaaaaaaattgtttttagttagcagagcatggcgacacatgcctgtagtcccagctactcagggggctgagacaggagaatcacctgagctcaggagtttgaggctgcagtgcaccatggtcgcaccactgcacttcagcctggacaacaaggcaagaccctgactcaaaaaaaggaaaaagtttgaaatactctgagaattaccaaaatatgacacagacacactaagtgggcacatgctattggagaaatggcattcatagacttgctcaatgcaaggttgccacaaaccttcaattttaaaaaatgcactatctgcaaagtgcaataaagcaaaacacaataaaacaaggtgggccaggtgcagtggctcacacctgtaatcacagcactttgggaggccgaggtgggcagatcacctgaggtcaggagttcaagactagcctggccaacatggtgaaaccccatctccactaaaaatataaaaagaaaaaaatagccgggcatcgtggcaggcgtctgtaatcccagctactcaggaggctgaggcaggagaattgcttgaacctgggaagcagaggttgcagtgagccaagattgcaccactgcactccagcctgggcagacagagcaagactctgtctcaaacgaaataaataaataaataaataaaaataaaacaaggtgtgcctacattaatcttggtaaagaaaaaaaatgcctttaaatcatctcctttccaccatttgttgttgacgggtttaggctatttttttttttttttttttagttactaacattactgctttcctccatataataacttatatttgttaaaattttattactatcaagtatttacatataattagattataattaaatatagttagattataattaaattataatttaaataaaattagagggaaggctgggcatggtggctcacgcctgcaatcccagcactttgggagtccgaggtgggtggatcatttgaggtcaagagtttgagaccagcctggctaacatggtgaaaccccgcctctactaaaaatacaaaaattagctgggtatggtggcacatgcctgtaaccccagctgctcggagggccgaggcaggaaaatcacttgaacctgggaggcagaggtttccatgagctgagatcgtgtcacaccactccagcctgagtgcctccatctcaaaaaaaaaaaaaaaattagaaggaaaaaacaactaatttagtggatttgtgggtttcataagaataataataataccatgtttgacccaagatgagaagagaaccagaaaaatgtgacttgtttgtcttttcctttttcagagtcctgatgaataacgtcctcacccgtttacctgataaacctctctgtcaacacatgccaagactacattggctgtaagcgattctgtctttttttaaagaactcaactaaattttctgtttttacctaattcattccagatataagattgttttagtttttcttaaaaatgataagggttttagtatcatatcacatttcctcaaactgctttaacatgatttttatgttaaacatctacattatctaaactaacatctctaaactctcagcaaaataaaacatctcaaaaaaaatatatatatatatatatatactggagccaggaagaagaaacacagaaggaatgtcaccacatctatgtaacatctccccctttccctgctggtatactcacctactaatttggtacagaaagactaagttgttttaatttcactctagaattctgaataataagaatatgatatttagcatttatttttcaaaaactaatcatgataaaatatgttccatggaatattttacaaagtagctttgcttgtagtaataagtatcactccaccatttagaactcaaccatccagtaaatttgcctatttagaacacaagtgaaaaataaaagaaagaaataaccaaaataactactaacaagttcaatcaacaaactgccatatgctgtatcatatgaaaactccctctgtctcttattttataagaaattctcagaagttggttgtttgatttctaagctcatagcagattacaaatgtcaaattaaaaggaagaggaaaagttagagtcagaagcattgattgtagtcagaagtaacaactatcaacttgataaaaaagcataagtgagaaatgctataaaaagcaatgacagtaattcaaactgtactaatctgcaacctctcagaaaaaaacaaacattctgaaaagttactaagtccagtaggcattttggtatgacagtataatactgtactgtacattgaaaacaagctaaagccataaaggaaagggcaaattaagttcaacatccctcattaaaattgaattttggttcaaatgaatacattagcatctattacagcctctgtaatcccaacttagtaattaaacacaattgaacaatatttacataattagcaattaaaatgtgtgcatttagacagaagcaactgtgtgcagtattatgcacaagcaataataaaccttgcctttgtttacaaaaaggcaagaaaatatacaatatacttcagataaacatcaaaatgattaagatgtattactaaaaaaattaaaattaaaaatataaaattaaaaattttgttactaaagttttcatatgtaaattctagctatccaaaacaacttattccatatgaattcctgatagtgaatattatcctgattttaattctagtaataataatactttgctttataattatttacctttttataactaatgatactattcttaccttgcatgaactttcatttagcacagtatgaactagaaaatctgacagatttcttggccaaacatcattttaactctgatttaggggaaaaatacatacaaactaaagagacagatgacagcccaggaaattatgcttctaaggtatttgcaggacaataaactgaaacctatattagttcttgcaaagcaatgagaaactgtaaatgccacaataaaagttgtaaaattcaaaaaaaaagaaatataagtaataagcaagcataaggacagatatggcaatagccaaaggtgaactaaaagtcaagaataaagtaaacttttcttttgagatgaaattaagcaagtttatttattagccaaagaagtcaatatgaaaagcttgaaaatatagaagacgatgggaatacataatagtgcaaagtactagaagacatggaaaagaatggaaaagtaaaatgtgatcacacacacacacacacacgcatacacacagcagtgaaaatgaatgaattatcaatacttcaatcaacatgactcaatttcaagcacatatgaattactcaagaaaaagtcacagaagactacatatattacatttccattcctataatactgattaagatatagaaagccacaagacagcagtacttcctctctacctataagaaagagctttgtaatctacaaagtcataattttgtggagcccatcagtaggctacagtcataaggtagccaaataaatggaattctaacaagcaacaagaagatgtgggacatacatactatttcacctttggcagagcacaggatgaagagttggctggcgtgaaagcaggtacaaagaaaactaaaactttaataaacttgtaagcttaagtgtgggctactatagtgctttaaaagaactgggaaccccatatgcaaggggatttagctatctttaacaggctctttttcactgatctccaccaaccacaagaaaaactaggagtaggtaaggaaaccagacagagccctcattggtagcacaacacaaaactccaccttcttctctaaactcacccgtctcagggaacaaaagcatcaagcctttgggagtgggacagaaaatcctcctgcacccagggaccaggcaaaggtccattacttccataggaggaatagaaactagagcattctgccccagggtaccaacaaaaaaaaaaaccactccagcccaggatcttgcactgatcaaagcagtgggtagtgcccatttgtatcacggcaggaaatgctcttatgagagtttggcttctggagaagggggaacagcaaagctgagacagccccatccccaaaagcataaggaaaaagaagttcatgtcaaattataaagcaatcaacagaaccagaaccagcaataactcagattttacaacttccaaacagagacattaaaatgcttatgattaataagttaagtaatatagtggaaagatggataatatgcacgaacataaagaaaatgtcagcaaaaagatggaaactacaaaagagaaacaaaaaattatttcaacagccttagcagcagaatgaacacagctaaggaaagaatcaacaaccttgaagatatgtcatagaaagctttcaaattgaaacgaaagaaaaagagacaaaaataaaggcaaaacagaatccaaaagctgcaggataatacaattgtctaacaaatgtgtaaatggagtcacagaaaaagaatagaggaagaacaggacagaagacaagctggagaaataatagccaagaattttgttacattaatataatgcaacaaaccagaaatctaagaacctcagaaaaatccatgcagaagtcaagaaaaactagataaattatagtcaaactgctgaaaaccaaagataaagaaaagtatcttaaggcaatcagagaaaacagaaacattatacactgtaaaacaaagacaagaaaaacaacttttttttaaaagccagaaggactatggtaatattggcgaaaaagatttcagaacaaggactatcaccagggataaagagcgatatcatataataataaaaagatcaattaagcaaaaatatgtgataatcttaaatgagtaaacagtttcaaaatacataaagtgaaaacaatagaactgtaaagagaaatagctaaaagtcaaaggatgtcatttaaagctgatgaatctttggccgggcatggtggctcacacctataatcccaacactttgggaggccgaggcaggaggatcccttgagctcaggagtttgagaccagcctgggcaacatagtgagactctgtctctattaaaattttttttaaaaaattagctgagcgtttagctgggcgtggtggtgggcacttgtaatcccagctactcgggaggctgaggcaggagaatcacttgaatcctggaggtggaagttgcagtgagctgagatcacaccattgcactcccgcctgggcgacagtgagactctgtctcaaaaaaaaaataaaaaataaaaattacctgagcatggtagcatgcacctgtaggcagtcccagctactcaggaggctgaagtgggaggatagcgtgagcctgagagatcaaggcttaaatgagctatgattgtgccactacactccagcctgggcaacagagggagacttgtctctggaaaaaacaacaacaacggacaaatccatagattagatagacagtggtattcccaaggtgaacactaataaaaagcatgtaattaaccaatattgtatggtaaagagaggcagaggagcagagaggaagacaatgtacacaaattttatcatttcttagtatcatcaaaagaaagaaggtatagtgcattgagtaaagttacaaagattgccaatagaatatacaaagctttgtaaatatcataagaaataaattttttaaaacaccattaggttaagataaatattagacacaaaaaaaacctgaggtgaaagttttttaaacctatggaatcgtgtaataatatttttaaaaaacagactaaggccaactatattaatcatatcaataaatataagtaggctaaactcacctattaaaaggaaaaagactgggaaagaagacctgggaagatatttctcaaaaaatacttaaaaatggccaacaggcatatgcaaaaatgttcaacattactaatcatcagagaaatgcaaatcaaaaccacaatgaggtatcacctcacacctgttagaatctctattatcaaaaagacaagagatgacgagtgttgacaaggttgtggctagaaaggaattcttgtgcactgtggatgagaatgtaaattagtacagctattatggaaaacatatggagcttcctctaaaaattaaaaataggaccaggtgcggtggcttacgcctgtaatcccaacactgtgggtggcagaggtgggtggatcacttgaggtcaggagttcgaggccagcctggccaacatgatgaaaccccatctctactaaaaatacgaaaattagccgggcatggtggcaggcacctgtaatcccagctacacaagaagctgaggcaggagagtcacttgaacccgggaggcggaggttgcagtgagccaagatcacacccctgcactccagcctgggcgacagagcaagactccatctcaaataaaaaaaaaaattaaaaatagaactaccatatgatccagcagtcccacttctgggtatatatccaaaggaaattccattagtatgtcaaagagatatcttcactccaatgttcattgcagcattagtcacaatagccaagatattagtcaaccttagtgtccaatgacagttgaatggataaagaaaatgtggtagatatatacaatggaatactagtcagccttaaaacagagatcctgccattttgacaatatgtgtgaacttaggggacattatgctgagtgaaataagccagagacagaaagaaaaatactgcgtaatctcatttatacgtggaatttctttttaagttgaacacatagaaacagagtagaatcgtggctatgggtcatggcagggggaatgaggagatgtaggttcaagggtacaaaattacagttatgagatgaataagcatacagatctaatgtatggcatgtctatagtttaataacactgtattgtatagtggaaatttgctaaaagggtagagttcaggcactcttaccataaaagaaattaactatgtaaggtgatgggtatgttaatttgcttggttgtagtaatcagtttactatgtactgtatatcgaaacaggctatataccttaagtatacacagtttttaaaagtatgtcatgtaattgcaaacaaaagaaagcaggcatcatatattttatctaagtaggtggaattctggccaatgtgcattaaacaacacaatgacattttaatgctataactgccaatgtccaataaaagatatcacattataagtctatacacaccaaagaaattaatatagcaaccaaaacaaaagaaaatgtagacatacataagcagtaagaaataatccaccactgggtcaggtgcggtggtgcatgcctgtaatcccagtactttgggaggcccaggcgggtggatcacctgaggtcaggagtttgagactagcctgactaacacggtgaaaccctgtctctactaaatacaaaaaaaaaaaaaaaaattagccaagcatggtgcctgtaatcccagcaaatcaggaggctgaggcaggagaatcacttgaatccaggaagcagaagttgcagtgagccgagattgtgccattgcactccagcctgggcaacaagagtgaaactccatctcaaaaaaaaaaaaaaaaaaaaaaaagataatccactacttctcactccataaaagatcaagtagaaccaaaataaataaataacataattagtaagttaatgctaatcagtgtatatcaaacttcagtgccccttctcaataacagaactgctttctttgggacagcaacataactagctaaaatactacattcccacacttctctgcattcacatataggatatgtcttaagttctgactagggaggtcgaagtattacagtgtagaacttcaggaaaatctccttaaagagaaagatgcaagtcctttcttttccttctttatccagaaaacaaaaaactgaatatgatggcttgagctttagcaacatcttgtaccatgaagacaagggcatgtgatcagtgaatatgaaagatcctgggtttctaacaactttgtaaaacaaccatatcagccctgaactgcccaactctagatttttttttcctggggggaaaaaaccccaacaactctgcgtatttatgctattatagatgggtctctgttatatgtacgtgcacctaatcctaatagatatgaacttgaaagcaaagaatgcccaaagaacattcaccaaaattgaccatatattttaggacataaacatacacaaaccaaactcaagaaaacagatggagggattagcctaaaacaggagaagggtcatctcttcctctgagactagaaagagaccaggtgcatatacaggtaagtttacagatgtcaggcagcaagtcaagggcttttcccttcttcatcacctcagttttctctgtgaaataggagccagaaatgtaaaaggtagaggaggaagcagatagagagtaagattttcatgttttgaatgccactaagggacaagttgagggagaatagacaagattatagtctttgtcttttgttattgttgttattcagattgaagaaccaccaaagttttcatttttatccaattctaccaggtataaagggaaaaataaaatggttagtctcagaggctcattagataggaagggtggtggtttaaacacagtaaaaaatagaaataaaaataaaaaaaccttcgttaactccattaaagcttgcagctagggagcaagaaacagattttttgttgttattttgattttgttgttgtttttgcttcagctaagaggtatgctgcaaaccagatccctgcttatcaaggactaaaacccctaactttaggaagaaaatatacatattcatatgtatgctcatatacaggcccatagaaacacatcatacaaatgtgaccccaaatgtttttattattaacacaggaggggggaaaaacagtaaataaacaacccaaggttaaaataaattcaaaattaaactaccaatttaatcaaatgtcctaatttgtgccccaatatgtgcctctttttgattttcacaaattagtaaattagtactaacaaatatttttgccagcctaatagaaaacagttacgtaagtaactaaataggaacatcaactcacctcattaagcgcattttgtgagacttaagagagcatcaccacctggtggtagattcagggtaatgattagcaaccaaatagaaggaaatggccagtccctgtcacagataacatacattatgagagaccaaaagccttggccaaaactaagaccaaaaaaagtagcactataagtgattagcttccaacttaatagaataacagaaatttggaagggtgatctagaatccacatttaagattctaatacaatatcccatgtagtacaaaaatcctgtctacaaaactatagagatatgatacattgtctgtgctaaatacctgtagtaaaaagaaacaacttctctggatatcatagattgctagataggtttaagttgggtttaaatttgaaactttttatgtccctcgatcagtcaatctaattttgcaacccaatgcaacatagaaaacccctgatatattctatagcctgacttcaaatatatctctcattttgtttttgtttgttataaataacaccccatattcttcaattgccttgatttctagataccgtacatcctggtcttccagattttacagatatatttgatttgtcagcatctatttttaatgcagcacctaaaataaaactgactcacatgttggcagtggagtataggcacttctattaatactttccatgtttcctttcagattttaatagctgtatcacacttctgctcacatgttttagtgacaattattcctgaacagctttatgttacatggtgaccagtaagctgagtgttagaagaggctgaatagatttaagggccggcatttacttttgaaagtctatccctaaacctcagctctcttcctctgctctataaagttccaccatatactcacttatgaaagaagaggaacaataaaagagtaacttcaagataaccacgaagagacagtaaaacataaaaattttgatacatttttatgcttagaccataaggaggtttatggtgacataggcatcacacagcaagggagccccaggaggattatatttagatatctatatagatagatagatagatagatagatagatagatagatagatagatagatagatagatagatagatgtagagatagagatatatgcagctctctgaattggagatgcagaacctaaggcagtctgctgtttgctctctgtctgcgctggcctttgagacaatataaaaagcaaataagggtattcccaatagtaaaagattattgaggattttttctggggagtgattaggctggaaaggtaggagctaaatattgttttggcagcagcagcttttgcaacaataatagaatctgatgcagactgtagcaaaataaaatcacaccacttagggaaatgccatcggtaactttggacaaatgtttcatatggttcattatgaaatatcggttaataaattaggtgtttatcataacaaatgttttcaatttgacttcttgttcttttcaatttctcatatacatgcccgtatgcactcatgatacagatgggacgcaaaacatttttacctttaacatagaaaaaagtgtataatatagatatttatatatataatttcagctgtaatagaaatggctacaagtgagagtctatatgaaataaacagtatgtaaagaaaagatattttattagaaggcaaataattttaaccaatttatttctctccatgattaagatttagctgtatcgttttatttttatgttccagggaccttgaaggcaaccatatccataatttaagaaatttgacttttatttcctgcagtaatttaactgttttgtaagtaatatgctatgcttttgaagtaatattatcttttcttacaaataaaatttaaaaacacccattttatggaaaaaaaatcccaaagaacatcaagagtctgttgttggatctcagtttgagaaacactaaattgaagtcttagcctataagaatgtttatcctttgcaaattattatggtataaattaagtttttctttacaattgtgaaaaaatagttacaatcaaaatgaaaaacaaaatactgctgaatgttcacaaccttgaggatgtaattatggacatcaagataaaccttgaagtgttaatgagtgtaattccttcttatgcatctctggcctattttaaattcacatggtattttctgttaaaagtaaaggatgttaggtcttccttcagtaaaaaaaaatccaactctcctattcacagcttattttaccagaatgtttttcaaactatggattgcaactaataagtaggtgatgaaagtaatatatagcacaatttattatacccttgtcagcatttttaagggaaacagaatttaattgaatagattatatcagactgcaatgcagataataaatgtattgtttcatgagccttagggtgtgtgtgtgtgtgtgtgtgtgtgtgtgtgtgtgtgtgtgtgtgttttatgatccaatataaaacacattttttactgtgtgttaccacaggaatgatttgaaaaccattatcctagactacacaggacccctgtatataggcgatacaatagctcccactgatattaccatatgttttctccaattccccccattccaatgggttccaatgagttccagtttgaactcctcctgagttcagcaatcttcaggtacagggtgcttgatataaataatgcaaaatagtgtatagtaattgcccaaaggaaaccaaattgcacctgaaggacacagaacaaatagatatctgaaaaacttagaatttcttttctattgtacttgtatttattttttaaggaaacctctgtattaagagattatttgtggatttcctcttggcaggtgttgtgcttttaaggtccaagaatattgggaaatggtggtaatggtttggagtgcagtgaggaaataaatgggaaaggacaatttgaagacatgtcatacaatgtttaaaaaattaaaagccctttaaaacttagttctgagttggtcctctaggctagctggtaacacatgagatcagtgcagaaatgtcaagagttaaacagactgattcagcatcccaaattagagattcttctaaaggggttcagctaagagtggacttccttaggcagatccgcccgaaatcacatcaagtaacaaatgagtaggagtgctgtggtgggtgggctattttgttagacagtcatgctatgcagactgaaaagacaagtctaaaacagctcctatgctcttggttgcaagatatgcagtctgtattctcaaaagttggggttttcaccatttctcgtgcaaagctcttcctccctatttcacttaaaattttgaatttctattattatcatcatcaaaacatttgagaaatttaggattaaaattaaattggataatttatactacttcaaaatgtctttatgtgaaaaatgtactgtatattcattatctttgtttctgcataccgttcctctctttagtaattcttgtcggttacctaaagaagttacaatgtatttttctttttactttcagagtgatgaggaaaaacaaaattaatcacttaaatgaaaatacttttgcacctctccagaaactggatgaattgtaagtatgactgaacatatactgataagaattttctttctactgttttttcacacttgtacttacatgtgtttatacatttaagaaatattacttatctcctctttctaagcattatttacatatatacacctcaagccacaaaggaattcagatggcatacaaaaaatatggaaaataaaaatataaatatttgaggaaagtgggttaaaggaaacacagctgtaaagaaataataaagccagtataaaattaataaataaaatacattctacaccactctgttctactcctaaagaaggacggtaaatttatggggggttttttgttttgtttttgttttttgttttgtttgttttgagacagggtctcactctgtctcccaggctggagtgcagtggcatgacctcggctcactgcaacctccgcctcccaggttcaagcaaatatcctgcctcagcctcctgagtagctgggattacaggtgcatcccaccatgcccagctaatttttgtatttgtagtaaagatggggtttcaccatgctggccaggctagtaaatttgttattatgtttcctaaaggattaggattcagggaccataagattagaagataccactttgctgatttgaaaccaaaggataatcttgtatccataaggaaattagacactactgtggataatattcctacctataataatggaagagataaattatttttataatgcccctttttaatgccaatgacataattctaaagggcactataacaattctatgatgaaccaaagcccgtggtctaagtacattgtagttgattttcagaataaaatagatgtagaacaatggatgaagtgcttatccttcagaccatttttttatattttagtgtcaatttttttcttttcattttttgtttgctttttttctagtaccagggtgtcactctgttgcccaagctgaagtgcaatggtacaatcatagctcaccgtaacctcgaactccttggactcaagtgatcctcccacctcagcctcctgtgtagctacgactatagcacaccaccatgcccagccaatttttttttattttttgtagagacagggtctctgtgttgctggggctggcctagaactcctggccttaagcaatcctcccgcctcagcttcccatacttttggtattacagacttgagccactgtgcccaagtagtatccatcttctggaaagaatctgaatgtggacagagctacttgttttgacaattagctagacagaacactgatttattaaaacttttccataaaaattaaagaatacaattagaatgttatgaaaataacaccaggacaccttacttgggcactcaagaagttacaatgtgtttttccttatgctaggtagagggaatacatgtaccaggagcaggaacgtttctcaggtaacaatcctgcattctgccccaaaacatcagggaatgagccattaaaaacccaacattttatctgtagcctgaaacacttttggtggtcagtaccaatcattcacaaaatgtgcaggaaaatctcaaaaacaaatagacccaaccatctgttgtagcaactcctggcacgtgataattgaaccatatcatcagcacataggaaagtagtctaaatagtagggggagatgcagctggatgatccaaagtattatctagacattagaatacaagttagtcaaggaatactaactatatactttttcttgtttcatccacttgaaatcatacctgaatatcaagggacagttccttcaaatcctagccttcatggtggcagtcaggtgcagattttatatatcaataaccaacagtgaacatgaactcaaagggcttagtgcataaccaatgctaatccaggttcagaagtaaaggaaagaataatacaaactgcagagggtgaccaaggccaataatttgtcttgctaattattaggtggactttaatgcacctaatcccatattaaacacttacctgaaaaatcagattcaccaggacaaaaatagcatgttttctaagagtcgatggctttcattggatgagtctatatctaaagtgtccttttgagagagggttgaactacactctgtgcccctccaggctccatcacaccaacagagttaatgaggacaaagaggattcacttgtcacagaggactttaagtagctctagtgacagaaaatctttgccacgtgggtgacttaatttgagcttttaaagtcaactactctagtttacaaggtgtttcctgagttcattcagaaatggaccttgactccaattaagtttagcctaactttcctaaacttaagctgagaaaatggccctttcaaatgtcacttgggatctgggccaacactatcccattacatgattcatgctgttagaactatctgccaggatttgctctgataacaaaacccacactcccaccagtaattgttgaacaagacatttggaattttaatatcccagtgcaccattttaaatccatttgcacattgctttactaatatgatcaatattttacttggcttcctatacaaggaactgaaattgtgccccacttttactaaagatgaagcagatagactcagtgtattcatagtcttctaactggggatggagaaaacagctagtccaaaactgagctaggcactgggtagcccagatgaatagatatcgttcttgtactcaaagaactcacgtttcagaaaggaagcacatatgtacagaaacagttgtagtatgatgttatatgtgctatatgtgttatatgtgctatactagaagtgtgcaagaggaatgcataggagaacaaaggacaaaacacttaacctccctgggctcagaggttaaacagaggaatgacgtttgaatgaagtctagaaggatgaatatgagatcacaaggagggaaagaagagcatggggattaaaatactgaagtgcattcgggtcatggtgaaaagttactttggatagaaagtggtaggcaaggagactggaaacatagtcaatggcaagacatttgaatatttaaaggttcattatggccaggcgcagtggctcacatctgtaatcccagcactttgggaggctgagacgggatgatcacttgtgcccaggagttcaagaccagcctggggaacatgaagaaacccagtctctatcaaaaatacaaagattagctgggcatggtggcatatggctgtagtcccagctactcaggaggctgaggcgggagcatgcttaagcccgggaggtggaggttgcagtgagccgtttgtgccactgcactcacacaatgcggttttgatttcatctcctaaggtacagtaagctattgaaggagattccaactctttatgaaagagatggaatttttgagtaattccttcagttgtctaatcagaacaatctgttgacaattcaccgataaatatgtaactaacagcaatagtctccaggttcagtttgcagcaaagacgtttataatatttatcacattatattagccacttatttttagttttaaaaactcagtctaaaaattgtcctacccttcgaggtcaaaaaatctaacgtttgccttataagcaaaccagcatatataacaaatacatctattcattctcctacctatcccagtggcaacaaatatgatttggagatgaatagaagaaaaggttagactttcccttagtatctcttgatcaccttacagagctcaagtctattgaaactttttcttgtataaaagaatctgaggcctttcacatgagagctgccactgtcaaagctaccacgagaggtgctgctgtcaaacacctttttaggactaaggtacgaggtcataccatgttaagcagaccctctacacatacatgagatggcatgcaaagtatcctaccccaggataatatgagagcctgtgtatatcagctgtggaagaaactcgaacttgaaataatacacttccataataatcacaacaatcctaagcggaagaaaaaaattaagatcgcaaaccatgcatctattctaacacacaaaaaaagagaacaaaggaagaaggggcacaacacagaaatcaaaagaatgagaaaatgcgattgattaaaaccagatcaggccaggtgcagtggctcacgcctgtaatcccaggactttgggaggctgaggcgattggatcacaaggtcaggagttcgagaccaacctggccaacatagtgaaaccccgtctctactaaaaatacaaaaattagccaggcgtggtagcacacacctgtaatctcacctactggggaggctgaggcaggagaatcacttgaacccgggagacagaggttgtggtgtgccaaaatcgcaccactacactccagcctgggtgacagagtgatactcggtctcaaaaaaaaaagatcaaataccatcaagtatttgtcttccaggggatgatgaaatggaataaaatatttttatattttccaactttgctccttttttaaatttttagacttctggtgattaatataactcaccaatggcattgttgaaaagttgtatagtggtttcctaatgaatttcagaacaatgagtaaagtcttaagaaaataatatcacatatttgcaattatttctccagggatttaggaagtaataagattgaaaatcttccaccgcttatattcaaggacctgaaggagctgtcacaattgtaagactgatgttaattttgccacctcgtttctttattttattattttttaaattgtaaaatatgcataacataaaattagccatttttaagtgtgtagttgagtagcattagctacattcacattgctgcccaaccaccaccaccatctacctccagaagtttttcatgttgcaaaactgaaactctagccactaaacactaacttcccactcaccgtttccccatcccctggctaccaccattctactttgtgtctgtgtgaatttgactactccagatacctcatagaagtaaaatcatggaatatttatctttttgtgacaggcctattctacttagcatactgtcttcaagtttcatttctgttgtagcagaaatgaatttccttccttcttaaggctgaacaatatttcattgtgtatatgtattgcagtgtttattcacccatcaatggacattttagttgcttccatcttttgcctattgtggataatgttgctatgaacatgggcgtacaaatatctgttgactctgctttcaatttttaggtacctactctcaaaagtagaattgctgtttcatacatttctgtcattttatttttaatgcatgtttcattctgttttccataggagtttaaccattttacatttccgctagtagtatactagggtttccatttctccacatccttcccaacacttggtattttctgtttttttgataataggcatgctaatggatgtgaaatggtatctcactgtgattttgttttgtgattcccagtgattagtgatgttgagcaacttttcatgtgcttattggccatttggataccttcttgcagaaaaatctgttcaagtcattcactcatttttcaattggattgttcaggttttctgtagttgttagattgttggagttcttatatattctggatgttaacttcttttcagatacatgattttcaaatattttctcccattgtatgggctgccttttcactctattatggtgtcctttgatgcacaaaagtttttaatttatgtatagtctaatttttaaatttctttttttgttacttatgcttttggtgtcatatccaaaataacaccaaatgtcattggtgtcatgtcatgaagcttttcctgtatgatttcttctaagagtcttatagtttttagctttaatatttaggtcttaaatccattttgagttaacttatgtacatggtgtaaggtaaggatccaacttcattcttttgcatgtggatgtccagttttctcaacacaatttattgaaaagactactctttccccattgaatgtccttggcacccttgttgaaaatcatttgaccatatatctgtgagtttattcctgagctctctattctattccattagtctacatgtctgtatttcagccagtaccacactgattgctgtagctttgtagtatgttttgaaattaagtggtgtaaaatctccaattttgttctgcttttttcaagattgtttggctatgtgggctccctgcattttccatatgaattttaggatggattttcatatttctgcaaaaaaaaaaggcaatgggattttggcaggttgctttgaatctgtagctcactttgagcaatactgacatcttaatattaagtcttctgatctgtgaacatagcatgtctttcctttcattggtgtcttccttattttctttcagcaatgtttcgcagttgccagggtatttatctttcacctccttggttaagtttatttaagtatattattcttttgatgctattgtaaatggaattcttttcctcattttcttttgtgattattcattgcatatagaaacacagctgatttttgtgtgttaattttatatccaggaatgttgatgaatgttttagttcaaatggatttctttttagttaaatctttaggatattctacatataagattacatcacctgtaaacagagatcatttttttcttcttttacaatttggatgcctgcctttcacttttttttcttgccgaattgttctaattaggacttccaacattatgttgaatgaaagtggtaaaagcaggaatccttgtcttgttcccactcttaagggaaagcttttggtcttttaccattgagtgtgggttttcatatacatcctttattatgtgaggtagtttccttttatttttagtttgctgagtccacttcatttttttatacaacccattggtcattgtcattctttctctctttccttctttctgtaactgtggctcccccagcagttccttccatcccccatgtaacttatggtctaatcttcagtaaatatttttgtttatttcctctttttttttaattttgtttttgtagagatgggggcctcattatgttgcccaggctgctcatattggacttcaaggctcatgccattctctcacctcggcctcccaaaatgctgcgattacaggcatgagccaccacacccagtctaaatattttaaaaagagaaattttcctgagaagtttcctttaatcaatgattcttgtttcaaggtgttgtttttcaaagattctgaaattttctccatttaaatttacctttcagttctctttaagaaggcaggtgcttgtagtcccagtgagttgagaagctggggcaggaggatcccttgagcccaggagtttgagtacagcctgagcaacatagcaagtccccatctctaaaaaattaaaatataacaataaattccctttaaagtctacttttcatttcatgtttcatgacttaagatttattgtaaaatatatgatatattattccattaattcaaattttgactaaatgagattattttatttcattttgtttaaaccatatctgatcttaggcaaaatgtgaagtagatgcggctctttctcagtcccctaccacttctctggtggcagccctttcttgacagctccgccttcatgcctatgttttattaggtctcagtctatcactaccgtaatcacagagtatctaccacaagctgggcactgttctaagtgttttatcttaattaattcacttacatgtacaatcaaccctgtgaggccaatgctattgctatctctttatttcactgacaaacaaaaattgtatatatttatcagtacaacatgatgttttgaaatatgtatacattgtggaatgcctaaattgggctaattaacatatgcatcatctcacatacttattttttgtggtgagaacacttaacgtctactctcttagcaattttcaagaatacaatacattgttatttgctatagtcagcatgttacacaatagatgtcttgaacttattcctcttttctaagtgaaatttttgtaccttttgaccaatatattccaatcctttcccacctgcctctagtgaccaccttctactctctacttccatgagttcaacttttttagattccacatataaatgagatcatgtggtaattgtctttctatgcctgacttacttcatgtagcataatgtcctccagattcattcatgttgttgcaaatgacaggattttctgtgttttttaaggctgaatagtattctattgtgtatgtatacatatttttttatcaagtcatcctttgatggacacttgggttgaatccataccttggctattatgaataatgctgcaatgaatatgggagtacagaaatctctttaatatactgattttatttcctttggatatatatccagtagaggaatttctggatcatgtagtagttcaatttttgatttttgaggaagccccatactattttccataatggttgtactaatttatattcccatcaccagtatgcaaggggcaaccttttcttcaaatcatcctcaacccttatctttcatctttttgataaaaattattctaaaaggtgtgaggtaatattgtggtttcagtttgcatttctctgatgattagtgatgttgagcactttttcatatacctgttagtcatttatatgtcttcttttgaaaaatgtctattcaagccctttccctaatttttaaccagcttatttgttttcttgctgagttgtttgagttccttacacattttgggtattaaccacttaccagatatatgatttgcaaatattgtcccccattacacaggttgtctcctcactctgttgattgtttccttagctgtgcagaggctttttagttttatgtaatcccattcatctatttcacttttgttgcctatatttttggggcaatatccaaaaaaatcatcacccaggttaatgtcctggggctttccacctatgttttcttctagtcgttttataattttacagtttaagtctttcatccattacgagttattgtatactttcgttcataaatatgttaaagtaacccaaaataaacagattcactcgctttactcatgtagtttttagaaatgacctattgctgctttttttaaaaaacaggaatctttcctataatccaatccagaaaattcaagcaaaccaatttgattatcttgtcaaactcaagtctctgtaagtattcacatatggggatagttttatgataaaattgttttttaaatactaacaatgtatatttttatatatttacttcaaatcataagctttatttccaagacattagtttagctccacaaaaacatatgggtgcttgctgaactataaacagacaactattagttttatcttatatacttgtaaattaaaaaataatgatgaattattttatatttttctataagtcattaggagcttatgttgatttgtttgctttgacccttcaaagacatctgtgcatattcactctcttaacactgggtattttataatttattataagtgtttttaccccaagatggaatatgctagattatataaatccttacttgtaccacacacacacaaaaagacaaaaattctgttagagccaaagaattgccttaaaagataagcttcagggctgagtgcagtggttcacacctgtaaactcagcactttgggagtccgaagcaggaggattgcttgagatcaggagttgaagaacaacctgggcaacatagggagatgctgcctctacaaaaaaataaaaataagcaaattagttgagtgtggtggcatgcacctgtggtcctagctacttgggaggctgaggtgggaacattgcttgagttgggaggttgaggctgcagtaagccctgttcataccaccacaccagcctgggcaacagaggaagaccctgtctcaaaaaaaaaaaaaaaaggtaagcttcagttcatttaatttgagtgttccctcagtaaaatgacattttattagaaaaaaatttattaattaaaaattactaggaaattttcaaggatgtaaagcatcctctgctattgtaatattgtacaaaagataatgcttgtgcatttattccacacatatttattgattagttaaaatgcacaaagcattgtgccatgatctgtgaggatctgaaaaaaatcaaataaggaagataatacgtgtataaataacacaatcagaaggaggaggatttggggaagtgggtgggttgagtataattattttgttcagagtaagtgttaactaaaagcattttattaaattgtccttcacagaaactcaatttattaaaccatgtataatacatgttcctttgattgattattaatttgatatttttagcagcctagaagggattgaaatttcaaatatccaacaaaggatgtttagacctcttatgaatctctctcacatgtaagtagatattttattgtttttcactgtgatgttaatatttgtttccatgtgtattatgataatgcatccaatctattaatattttctactaatttgccagctataaactgaaagtttgtgttcctccaaaatgtatatattgaaatactaaccccaatgcaatggtacaaggaggtagggcctttgggaggtgactaggtcatgaggacagagccctcatgagtgggattagtgcccttagaaaacagactctggtccaggccagtggctcatgcctgtaatcccagcactttgggcggccgaggtgggtggatcacctgaggtcaagagttcaagaccagcctggccaacatggtgaaacctcgtctctactaaaaatacaaaaattagccagtcgtggtggtgattccagctactcaggaggctgaggcaggagaatcgcttgaaccctggaggtggaggttgcagtgagccaagatggtgccactgcactccagcctgggcgacagagtgagactccatctcaaaaagaaaaaaaaagaaaagaaaagagactctggagacgacccttgcccctccaccttgtgaagacagacagagaagatggccatctatgaaacatgtggtcccctaccagacactgaatctgctggcaccttgatcttggtcttcccagcctccagaactgtgagaaatgaacatttgtcgtctaagtcactcagtctatggtatttttgttacagcagccaagtggactgagacatgtctaaacaataattaaaactcttaaacctttgatattgggtgagatgattttagttttccacagtctggtagaatctcataggagattttttgaatctcaggaaacatgatgtgaggggaatccacttggtcttgtaagaagttctcctcagctctaataactgttcacagatattgatgtttgcctaatgagctagtaattggtgtatagggtgtgttagtccattttgcattactacaaaggaatatcggaggctcggtagtttataaggaagagtttattttggctcacagttctgtaagttgtaagagaagcatggtaccaacctctaattttggtgaggtcgtcaggaaagcttttaatcatggcagaggacaaagagggagtaggtgtgtcaaatggcgagagagaaagccagagagagaagaggaggtgccagctctttttaacaatcagatttcatgtgaaataatagaaggagaactcacttattactgcaggaaggacaccacaccattcatgagggatctaccccatgacccaaacacctcctactgggccccacctccaacattgggaatcaacttttgacatgagatttggagtagacaaatatccaaactatatcacatggtacaagtgctaccagatgaagaggaaggaatttatataggcaatataaaataattataaataaatcaatgctgcaaatgaaggtagttaagaagaagtctttctcaatgaaaatatccccatatatcaaggcatgattcaagcaagcgtgcatggatgaaatggtaaactttgaaacatcttttattcaaagagtatgtctagttgtacctgtgattacatgctttagaagcacttttttaattgaatgcaatttcatagcagttattagaatgatccatgccatggaaattaattttcaataatttagatactgtcagctaccatcaactctgtaatcttgcttgtattttaagtctaacacagaaccctgtttttgttttccatagttcctcagaaagatggcttataaaagattcctttcttgtatgcaacataaagcaatctgactaaattaaacagaacagaatttattggaagaaaatggtataacacagaatctgaggaataatttatagcctctggaattatccatccaagtgtcattcaatcagattcagtttcagggaagagaatctagttgatcacgtctagggtacttacctactctgggctagggattgcctccactgaaggtcccaccataacttctcaaaaagggagaagtaattctctcaaaggaaatcagaacactattatcagaagagtgattgagtgctgggcagccaaagcggcaaacagagttactataattctgttgataaaagcaaaacttcagcctaagacacatagtaaaataccaatcaacactccttctttcctcatgttctgctctcctgtccttcatggtttacagaataaatggatataaccgaatggggaaatatcagcaattgaccttgagcttgacaggacaaattgtaatcatcaggtttttatcttttcttattatagctctttatacactaaagatcgtttatattttttggcagaacacatggctttatagacaaatagatctaatttgaagttcaatttgcatatttagtagaaaatttcctagcaaataacttgcctccactgaagattcatctcttcctattaatgatgctaacacctacctcacggaattcatttgagaacttatttctgatacttaagaaatgctcaataaaaggtgttggtgttggtggtaacacaatagtaattataaattatccacatggtatatttatcaacaaggaaattctctctgttgatgaaagaagtcactcaacaaatatttattgaacgctttattatgtaccaaaatctagtgtgagagataggcatgttagcaagtagttacagataatataacttcttttttttttcttttactgtggcacttccacgtttaaaatctttaatattattttgttatttttattaattgacaaataataattgcacatcttcatgggggtacatagtgatgttttggtacatacaatgtatagtgatcagatcaggataaaggataattagcatatccatcctctcaaacatttatcatttctttatgtttagaatattcaatatcctccttctagctatttgaaaccatacattattgttaactatagacatcctaccatggtatagaatatgagaacttattcttctttctagttgtaactttgaattctttaataagtctgcctgtctcttccttctccttaccctccccagcctgtagtatcctctgttctacttttacttctgtaagatcgacatttttagcttccatatatgagaacatgaggtgtttaacattattcctggcttattccacttaatgtaatgtcctccatttcccacctagttgccacaatgacagaatttcattctttttttatagctgaatattccattgtgtatatctaccacatttttttatccattcatctgttcatcaacacctaggttgactccatatcttggctattgtgaatagtgctgaagtagcattgtttgtatggggtaattcctgaggtttgttgcctcacgccaaggaaattaaggacgtggacacacagggagtgaggttaagagcagaggtttaatacgggagagaaagagaaaagctctctctcctgcagagagagaggggctcctgaataggtcttccagttctgtggtgaaatgcacagggttttaatacagtagcttgaggaagccatgtttgatttacatagggcccaaaagattgcttggaccaggtgtgccatttgtatagcatgcgaagaagctggctgccccaccctaatctttcattatgcagatgggttctctacctgtttggcaccatgttgtctgcttctttattgtacatgtggttgacaaagaaaaggaaagatggagcctccatgttgaacatgcttggcccccaggtagccttttcctattggcacagctgccagcattcacctgtgcaagcttctagcttgcttttctatgtctgcagcttaatttttcaggctgctctttgttagaaaagaaattatttggggctgctttttattaaaagagaaagcttaccaaggactctcttaccctcactaactgcctaaatactttctttttagctcctgtatcagtgctgcaataaacatgggggtgcagatatctctttgatatgattttcttttctttgaatagattctcaggaatgggattcctggatcatatgctagtttttttttttttttttttggagacagagtctctctttgtcacccaggctggagtgcagtggtgcaatctcggctcactgcaacctctgcctccacaggttcaagcgattctcctgcctcagcctcccaagtagctgggactacaggtgtgcgccaccatgcctggctaattttttgtatttttagtagagacgggttttcaccgtgttaaccaggatggtctcaatctcctgactgcgtgatccacccacctcggcctcccaaagtgctgagataacaggcatgagccactgctcccagcccacatgctagttctatttgtagttttctgaggaacccccatattgttctccgttctccatagtgcctatactaatttacattcccgccaataacagttcccttttctccagattctcatcagcatttgttactttttggtctttttgataatagccatccatccaacgttggagtaagatgatacctcattgtggttttaatttgcatttccttgatcattagtgaggttgaacattttttcaagcataggttggccatttctatgtcttcttttttttttttttttttttggagacagagtctcgctctgtcgcccccaggctggagtgcagtggcacgatctgggctcactgcaagctccgcctcccaggttcacgccattctcctgcctcagcctcccgagtagctgggactacaggagcccgccaccacgcctggctaattttttgtatttttagtagagatggggttttaccatattagccaagatggtctcaatatcctgacctcgtgatccacccacctcggcctcccaaagtgctgggattacaggtgtgagccaccgcgcccagccttgtatgtcttcttttgagaaatatctgttcagatcatttgcctactttttaatgggatgttttcttttctttttttcttttctttttttttctttcattggtgttgaaataacatcataacttcaataacaaaaagccacggaagcacagaaaagaaaacacttaactcttcccctgagggatagaaagcagtcacttgcagcacaataggagctgtgtaactgcatttacgtatactaaccattgcgagtacgataacggtttctctggagggattcattctcttgatcacatctaacagtttgtattctaagacatgtctaacacttgttatgtttattatgcctatttgctactctcacccacacattctttaacaatgaaatcaagctaatgataattggatgtaagtttaaagtttcagaatccctaatgttttagtcctctcaatttcatcttaagacattttctttctaccgataaaatgtaggaaataaatatgaatgtatggtgacactgaattaaatggaaaatcttattttactttctctttgtacaccagatattttaagaaattccagtactgtgggtatgcaccacatgttcgcagctgtaaaccaaacactgatggaatttcatctctagagaatctcttggcaagcattattcagagagtatttgtctgggttgtatctgcagttacctgctttggaaacatttttgtcatttgcatgcgaccttatatcaggtctgagaacaagctgtatgccatgtcaatcatttctctctgctgtgagtatttcctggttaaaggagaattgtagttttgaaatatacaaaagctttattattagaaaataagttgtgtgagtggtagaattatggaattttacatttttctcctttttgcttgtatgctgttttcacattttctacaaagaaaatagaattactttagcaataaaaaaatatgttttttaaactaggaaatttaatcaccttatgcaaattaaggaagctttcatttattagttctctctcatacagtggctccgaaggcacaatattttgttgacgcatctaaaatcttttactacaaataaaattgcaacctcctatggtcacaattttacatgcagacctatacttacttttttatgtgtatgtccagttcacagatattgacttaacaactacatgttttcctgatctctgagctactagaagttttttccactctaactgaaatgtgtaaataagaaaatatttttagggagtattcattttttcaaaaagtgtgcgcaatgtaatggcaaggtgttatgttaaatgaacactgcaaagaaaaataaggaagaaaccagtcctcaggatgtttgtagtctaggtcaagtgttctagaatttatccatgctccctcaagcaagtaaagcatcaatctacatgaggttctacttttgtatgtgtgctgcccccatgtgctgtccccatccttattcaaagtctaatgtctaaatgttttttttttattgcaagctatgtaagaaacagaactcagaagccatttactattttgtattgctagctacaaaatttttagtaagttcaatttccgtggtgaagcctagactgtaacttcagagttaaaggcttagggtcagccttgtgatttatacagtgatgtgattttagggattttgtgtagaatgcttgtgcgatccaaaaatctcacccactttctgatatgtaacgtttgcttaaaaagaaatatgccaagtagtgtaagagagctaattcctgggatcggagaccctaaaaagagacagaaaaagatgtaaaaattgaaagagagagaaaacagttttgcttagaccaactctggtaagtaatttaagccccttaaaattgtactgactgcaaagcagttcataattatacatatctcttaaattataggcttcagaattcagtcattattctatcataggaacttgtgaattactttctccaagattttatatgacaccttgagcttgttgcgttgggagaatttcagtggaagagcagaaccaagtaatgccatcctcatctgagtccctaactgaatgctctacgtgattgcattttgttcatttattcgacacttctatgtgatgggtctagaacaatagacaagatctgtgctgttagagacttgcactttaaaggaaaatgaagaaatgattgcataattaactgtagagagtaactttgagagtggttaccaaagagagtctatgaatagatcctcatctgtaaatgaattattaggagaataaaaattacctcttcctaagttggaagaaacttgactattttttctagcattaaaaatattattgcttattgatgattttatgatacctatttatttctctaaatttgtgaaactatgactcctctaggtgccgactgcttaatgggaatatatttattcgtgatcggaggctttgacctaaagtttcgtggagaatacaataagcatgcgcagctgtggatggagagtactcattgtcagcttgtaggatctttggccattctgtccacagaagtatcagttttactgttaacatttctgacattggaaaaatacatctgcattgtctatccttttagatgtgtgagacctggaaaatgcagaacaattacagttctgattctcatttggattactggttttatagtggctttcattccattgagcaataaggaatttttcaaaaactactatggcaccaatggagtatgcttccctcttcattcagaagatacagaaagtattggagcccagatttattcagtggcaatttttcttggtaagaaactaagaaactaatgttcacaaatttttatttcaaatcttccaaccagtttttgttagtaagaatgagggtgaattctatcagaatccccagcaaggattttcctccccaaattatactctgatataaattccaacctgacacagcttaataaaagacactaaacacctgtatttcatgtattcaccctaaacatgctaagcaacatatgttttggctctttgttttacaatatgaacataatgatatttattatcttttcaaattcatggcaacacacatctttggcttgtgagtatatatacaactgttctaaatcagcaatgtaaaaatattttcagagtacagcaaaaagtaactgaattagaaaaaaatcactaggccaggcacaatggcttgtgctataatctcagtactttgggaggccaaggtgggaggatcacttgaggccaggagttgagaccagcctgggcaacatagcaagaccccatctctacaaaattatttttaaaaaattagctggtgtgaggccaggcacggtggctcatacctgtaatcccagcactttgggaggccgaggcgggccaatcataaggtcaggagttcaagaccagcctgaccaatatggtaaaaccccatctctactaaaaatagaaaaattagccgggcatggtggcacgcacctgtagtcccagctactcgggaggctgaggcaggagaattgcttgaacgcagaaggcagagttgcagtgaggcaagatagtgccactgcactccagcccgagcaacacagcgagactccatctcaaaaaaaaaaaaattagctggtgtgatggcatgcacctgtactcccagctacttggaaggctgaggcaggaggattgcttgagcccaggagtttgaggctgcagtgagctatgattgtaccactgcacttcagtcagtgacagagcaagaacccatctctaaaaaaattaaaaataaaacatcactaatactagaaagcttaaaaacccaagatattcattgaattactgtaatttcaatatctcattttaaaagtaaacattttatcattcttcactacttccacaaaacctcatctcaaaaaaattcatgatttttgtggactttagtaattctttgtgaagaaaaaacccacacattatagtctttgtatctttagtaataacatctttgtatctttaataataaaaatgttttatttatgtttgttcattttgaaagaaatatttctatgcattaataatactgtttgtattccaaataggtattaatttggccgcatttatcatcatagttttttcctatggaagcatgttttatagtgttcatcaaagtgccataacagcaactgaaatacggaatcaagttaaaaaagagatgatccttgccaaacgttttttctttatagtatttactgatgcattatgctggatacccatttttgtagtgaaatttctttcactgcttcaggtagaaataccaggtacaatattttttaatctccttaaagaaataataaatctgtttttacagtgttcttttaaggaaaacaattaaaattcttaacactaaacaattcaaagaattgtacatcagatccgagcacagtggctcatgcctataatcccagcactctgggaggccaagacgggcagctcacttgaggtcaggagtttgagaccagcctggccaacatggggaaaccccatctctgctaaaaatacaaaaactagctgggcatggtggtgcaccgctgcagtcccaactactcaggaggctaaggcatgagaattgcttgaactcaggaggcagaggtggcagtgagccgaaattgcaccactacactccagcctgggtgacagagccaaaaaaaaaaaattgtaaaaattgtaagtcagagttgtaggtacttttggctctgctcatcaatataacatttactggggaagaactgtttatttttttccataaatgcctaacaatacaattactatggaacaaagaagcaatgagtgaccaaaataaattccacacggtgttgaaattctaatcatcacatgcttaaggtgactagaaaggaaaacaggccaaaacaattcttaaataattactgcattttttttcaaaatgtaagaaaattttcttcctgtaatacatgcaatttagagaagatcatgccagagtgtgagagataatagaagcaaacattcttggcatttagaaagaacgttggctggcatgttgcctcacgcctgtaatctggcactttgggaggccaatgtgggaggatcacttgggcccaggagttcaaagctgcagtgagccatgattgcaccactgcactcccgtctgggtgacagagcaagatcctgtctcaaaaaaataaaaataaaaaataaaaaataaacaatgtgcattacatccattaggatgactactattttaaaaaaacacacatacaaaaaaataagtgttggtaaagttgtggagaaattagaatccttgtgaattgctggtagaaaaataaaatggtacagctgctatggaagacaatatggcagtccctcaaaaatttaaaccatccaatggtttagttaccatccaatgtggaaatggtccagttaccatccaatgtggaaattctccttctaaggaaaaaaccaaaacaattgaaagcagggactcaaagagatatttgtacacccatgttcattgcagcattattcacaatagccaaaagttagaagcaatacaaatgtccatagattggtaaatggataaacaaaatgtggtacatacgcacaatggattagtatttagtcttgtaaaggaaggagattttgacaaatgctgcaatatagatgaaccttgaagatactgtgctaagtgaaataagttagacacaaaaggacaaatattttatttcacttacatgacgtttctgatatagttagattcatagaacatagaacggtgttttctaggggttgggggaagggagaatggagagtgtttaataggcatagagtttcagtttgggagatgaaatcattctggagatggatggtggttatggtacaatgatatgaacgtacttaatgccactgagctgtccacttaaaatggttacatggtaaattttatgttatgcatattttaccacaatgaaaatgcatatatcctgttaaatatatataaatatatatatatatatataatgcagtttgtattcacattttaaaattttcatgtagcagggcgcagtggctcacacctgaaatcccagcactttgggaggctgaggtgggcagatcacttgaggtcaggagttggagaccagcctggccaacatggtgaaaccccatctctactcaaaatacaaaaatttagctgcgcctggtggcatgcacttgtagtcccagctacttgggaggctgaggcatgagaatgcttgaacttgggaggcagagacttcagtgagcggagattgtgccattgcactacaacctgggtgatagagcaagactctatctcaggaaaaaaaaacaattgtatatattaatacataattttaattgtgttctgtactatggatgatggtgatagtatcttacattttatgaacaacaaaaagaaggccaagtggtgaagactgattgaacccaggagattgaaaccaacctggacaacacagggagaccctgagaccccaactcttcaaaaaataaaaaaataaaaaattaaccaggcatggtggcacatgcctgtggtcccagctactcaagagggtgaggtacaaggatcgcttgggcccaggaggtcaagactgcagtgagccatgttcacaccactgcactccagcctgagcgacagcatgagaccctgtctcaaaaacaaaaacataaaaacaaagagtaatgacagcatcaattaaattataatcaaatcagagtattttggtatttctatatatattagagtgatttttaagatgggtttagccaaagttattttttacagaaataaatatctggtcaaaagctaaaaaaatgcacactttgttttaaaatcaaatggcaaaaaagaaatctattaaatacaagcttacatattctgacaaatactatatgcaccattaaaatactcaaaaagtgttttaattattaagcacttaaatttatgacttaaatactaaacaatatgtttttcctaaaatataatcataatatgtaatcactttgtgaaaaatatttctacctaaaggaatatttttgttagtgtattcaagaagagctacttagcaaagaataccattctttttcagcactagcattcccctcacacactggcactctggaaagatatcttggaaacaaatatagacttggtatttaattatgtgacatcaaaggaaaaaaatcaaaactcaaaaaggggttgggatgaaagaaacagggaaattgggtttctataccttgtaaacatctataaacactaaaactatttcatttttcttttttaggtaccataacctcttgggtagtgatttttattctgcccattaacagtgctttgaacccaattctctatactctgaccacaagaccatttaaagaaatgattcatcggttttggtataactacagacaaagaaaatctatggacagcaaaggtcagaaaacatatgctccatcattcatctgggtggaaatgtggccactgcaggagatgccacctgagttaatgaagccggaccttttcacatacccctgtgaaatgtcactgatttctcaatcaacgagactcaattcctattcatgactgactctgaaattcatttcttcgcagagaatactgtgggggtgcttcatgagggatttactggtatgaaatgaataccacaaaattaatttataataatagctaagataaatattttacaaggacatgaggaaaaataaaaatgactaatgctcttacaaagggaagtaattatatcaataatgtatatatattagtagacattttgcataagaaattaagagaaatctacttcagtaacattcattcatttttctaacatgcatttattgagtacccactactatgtgcatagcattgcaatatagtcctggaagtagacagtgcagaacctttcaatctgtagatggtgtttaatgacaaaagactatacaaagtccatctgcagttcctagtttaaagtagagctttacctgtcatgtgcatcagcaagaatcataggcacttttaaataaaggtttaaagttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaacagcacttcttttggcacttcctgcccagttttctctttgctttaaatgaacatcatcatatggaattggaataggagagtatgagtacggcagagaagtggatcagaaaaactagaatgaggataaacatttacattagtggaaactcctgaaataaatccttgtattgtcagttaactgattttcaacaaggatgccaagacaaaaaggcttttcaacaaaccgtgctgttttaagaacagacctaagtggtttaattcacccactttagatgggtgaatgttatggtgtgtgaaatatctcagtaaagcagttaaaaggaaaaagagctggaatgcactgattcaggaacttaatttcaggaaggaaaggtctgtatgtacacatttcactttaagcagaaaatctttcttcaagaaatgactttactttctctttgcactgccagcacgtgagatactaactttttaactagttgttcttctctagtctctacgttattagaattttttgctttcataatgtgaaacctttaagcaggagaagaaaatgttttcagatagtttcaaatacaccaaaaatgtttgaaacacaaaaatactggaatcaaaccataatgcacttattgaatatatagttgtatagatttgttctgaaaataaattatctgaaatttaactattaa

SEQ ID NO: 119 - DNA, 131656 bp, Homo sapiens; identical to SEQ ID NO: 118

SEQ ID NO: 120 - DNA, 131656 bp, Homo sapiens; identical to SEQ ID NO: 118

SEQ ID NO: 121 - DNA, 131656 bp, Homo sapiens; identical to SEQ ID NO: 118

SEQ ID NO: 122 - DNA, 131656 bp, Homo sapiens; identical to SEQ ID NO: 118

SEQ ID NO: 123 - DNA, 131656 bp, Homo sapiens; identical to SEQ ID NO: 118

SEQ ID NO: 124 - DNA, 131656 bp, Homo sapiens; identical to SEQ ID NO: 118

SEQ ID NO: 125 - DNA, 131656 bp, Homo sapiens; identical to SEQ ID NO: 118

SEQ ID NO: 126 - DNA, 131656 bp, Homo sapiens; identical to SEQ ID NO: 118

SEQ ID NO: 127 - DNA, 131656 bp, Homo sapiens; identical to SEQ ID NO: 118

SEQ ID NO: 128 - DNA, 131656 bp, Homo sapiens; identical to SEQ ID NO: 118

SEQ ID NO: 129 - DNA, 131656 bp, Homo sapiens; identical to SEQ ID NO: 118

SEQ ID NO: 130 - DNA, 30583 bp, Homo sapiens
gtattttaaattgttgcagcagttttatttaaaaatgtaaatatttacaaaatggcagaaatcacacctttgaaggatttaaaacttaagtaaaaaatactacatgtcaacttaaaaatgtgcaagacgggatacatgatttttcaaaacttatttttgtagggggtacctagagcattggtttcttttggaagaaatggcctgatgcttctctctccctgactcctgcggctccgctgcagggacacagggacggaagccaagcctggaagctgccctggtggtcaactgaggggccatgtctaccctgcccaccagattccagagccttggcctttgggacaggccctggcttgctggatgagctgcacacctcctccaggctgaatcaagctgcccttggttgggggctggggccaggtattagcctggttggagtgataagggacagacccgcctgcaggtgctttgaccataaagactccaaacctaccagaggtcagagagagagagaactggcccgaggccagggcccgagcccactaaggaagatggatgtggccccctcagacccagccacgatccttggcccacaccactcttcgggtgcctgggtgacttgacctgaggggaggccacttccaagaggcatggtttatttcacagagagcagagatgtttctgaaggggagactggagggcaaagggcaatggggtatgagtttcaatcactgaagacatggttggtttctgctattcccatcccacgcctccctcctccatgcctctgctcctcattttgccccgcacgatgcaactggttgactaaggatgtggcttccctgatggcgtcttccttgattgcctaatctgtggactaggcagagaaggggtctcccaagagaggaagccaggcctggaagcctgcatccttcatggagcccccaaggcgggaggatggctggggaggggacacaggaacaagggtggggtacaagtgagcctctctaggtgacagcccctgggataaggcagccaaactgatcctttgctggcgtaccccacccaactgcaggggcaccactgagtgtggaggccaagggccagtgcagggccacaccattgcctggctgctggctccatgagtagggcaggggagccctgtgtctgctactataaatagctgtgtgtgttggacaggtccttctctgctctgggcccagtaaggccctggccagagaggctgggatgggcaaatgcctgcagacatctgactggctcttctcagggggtcctgtgaattccctctgcttcctcttgcgctgagcctggtggcccccactcatccctgtcccttgcagtcccccttggctgccgcaccccctctttcctgccaggctggagagctggtctctcccctcccatctcctgccccacgagagcctgcccagcacagagaacccagaggaagaaggtggaggaggacaggggagctgtgcaggtgggcgaccgaggggtcacacagcggccgtctgcttgatgctgtggaagctgatccgtgtgggtgatgtagggatggacatggcccgggccatggggactcgaagggagtgatggtcctgccagcggtgccacctcttcctcacggctgagcgcacctgtggggaaggcagaggctcagctggctcccagggaccaaccctgggcttctgggaccatcccctcctctgctttctgctctcatgggtcgactgccaccctcatgacaaggaactgtctgcttccaaaacaggtccttccctgatgctgttgcctctctccaggggcctcttccttatccttttcctggagaagcttgactccacacctcctttactccacactgtcctcccagatcatccagtttcctctggacacactgccttcccttccctgactcactctgccacctcaaaattagcatcttgggaccagagagcgcagcttggagacttggccccctcagccttcttgggcccctgctccttgcagggcgttggtggtgtgcgcccagctcacacacctggtgcgcctcctcctccctcctgaagaccgtcccctctgcacccctccaccttctctacctcctgctagactcccctgcctgactaaccatggcatttactgcctgaaagggaaagctctctgtcttggtcatttctaaagttggctctacccggtgccatttaagcttcatttgtttggtaattgaatttttttggaaattggatggtgtctctcacatcctagcttgcacatggttcgaacagaataaatgctccataaacatcccttgtttgtttgccttactggccccctctcttcttctcatccagcccacaggacccgtctctgctgatggactttgcaagtggaatgtgctatcatccacagagacacaggcctgcatagacacctcgccagtgccctgtgcagagacaggcaagtgtattcctctggagtgttcggaagctcccaggccctaggggctgtgtctgctctttgctccatgtcctcatccaccccagcccaggtacgagtgcgcttcttccctgcgtcagctgcactggggctttgggcctcatgattggcttgcacatgccaagcttcacggccgcctgactccccagagcctgctcttggtgtgtgggcttttctgtggcaggtagcgggggaatgtgctggtctctcttctgctccctgagtccatacagacctgattgcttggcacacatctctttctggaagcttccttctgtcaccacctctgctctggcttctctcttccatgaggccctgcggcctgggcttccttgctcacccagctctgagtgcacatgtggggtgctggcatgttatttcggggctgcatagttgaccttctaaactggctccagcccctgtgagaaggattcctgttcccctaaggccgggtggtatctcaaggcttcctctccctggcactccagcaaggccgggcagcaccaatggagctgccctggagtggggtctgaggacctggatatcccaggccaccccgagggcccagcttcatacctctccattgaagaagcagtagaagacagacacgaagaaaccctggaaaggagggaaaggagggagtggtcagtgacctacctgcggagctgttctgcctggtggggtggcactggggacaagatggtgggggggggacaatttgacccaggaacccctggagtcagagctgggtggggtcctagcctcagggtgcagatattccacggtccactctgagtgagcagtggtcacaggcctggagccaggcagactccggtctcctcaatattgtgtgacctgtcccagggcatttggttgggctgcctgcatcctcagaacaggtgctgggacagtaggtgcgggctggtaggatgaagacccaggctgggatggggataactggccaggctcaggctgagcatgtacgggcttctaactctgtggatgtaactgagccatgggtgtgccagtcccacgggacccccttagtgagggcatggctgccagagcagcctcaggaaagctcactgtggggcccccatctggtcacaggccccacctggaacgactgcaggaaggagttgaaatagatgaacatgatctgtgacaggtcgtcctccccgggattgacgaagaagagcatgtaggtgatgcccaggaggggcaggagcaccagggtggccttcactgccttcctgggggcgagaggtggacacaggtctgagcccatgcggcaggcagggcctcacccagtgggcggcgggagacagtggtggtgtttcttccgggagcttgagcgagctccctgggtgaggcctggggcagagggctctgccaggaagcagggggacggcccgatgacctcctcctgtccccattgtggggtcaagggaccccctcacatacctgtactggattgtctcggatgtggtggacgcgcgtaactttgtcattaggatcctgacgatgttgaacagaaatacgaaattgatctggagggagggcgggcatgggaaagagggaaaaggaaggagcacgtgtttgagatgagccgagaggcagcccccttccccgcagacccctggaaaccgatgtcccacgcacacacctatcctacctgtccccctagcacctgccagcatcccaaggcctgtgctcctccctcgccaggatggggagacagccccattttccagggcctgtgtctccagcccaggactgaggaggaaaggtggcagcctctgtgggtcgtgaccgagagcacggggcatgccctctgaggctgagaaagcccccaaccctctccccagtatagggaccctatgggagcccccttcccctcactgccacggggtccctacttgttgactgcggggctctctgagtcccttgcactgtcactggctctaggtcggcctgaggtccttctgactgaggacagcactgccatggtggggcggacaaggccagatggagggattaagaactcagttgccgaatgagtgattaatctgccagcatcccacccctgtgcccaggaactccagagccttcgtaggcaccctagacagggaagatggatgggctgtggggctggctctgaggccccaggaagggcctcatttatcttcattctgagttttccctcagcaccagagcctccccacccagcacctggccctggaactggcctgtgtggctccccagctgctccctgctgggtgtgggtccccatgggcctgcgagtgtctgttcatctgtattggctgtgactatgactgtgttgtcccctgggagctgcagtgtgggtctgtgggtctatcctttaagcacttgtgcaagtgtgtttgcctcacagagcgtgtgcatgtgtgagcatggatctggggcccgggcacatctgcgtttctcttcacctgcctccgagcataggcaggcaggcaggcaagggagtgtgtgtcggcctgacacagtggggctgtttcctgacaaagtgctcgtgggccagagggagacacatgttagcccaggggtgtctgctggctcgtgtgcacacacccactcacacacacacacacacacacacacacctctgacactctgtcaagaaaatccattgcttcttaagcttgggctgggcccttctaaccctcccaagttctgaatcctggctgggagaggagggacacaggatacagacagatatcctgagactgtcaacctgtagcctctggatgctccccacaagctttcgggtagccctaggggcagggagagctcacaccccacctcagccactgtctactgctctcttaccacatagtggtatggcctgggggtcccagggagggctggggatggaaagccttcagcggggctgccatgacctgatacccccagctttctcctagggctcacctaatttccagctcctgggtctctggcatattcccctggatcatgggacacaagtcaccttaacatataagtgaatcctaattttctcatacaagtaatacaaagtatttgaccttttctgattcttccggacttccctgagagtagaaactgttggaatcaaaatatattctcatttctgccacattttcttgaattcaatattaatcttccaacatccatcaacccactaatcaattcaattatccacccactttattcatctatccatctatccacttacctaccaaccagttcattcatttacccacctacttttatccatccgtccatccatccatccatccagccattcatccattcatccttccttccttccatccatccatccatctacccaacaaccaattcattcaattatccacctactgttttatctatccatccacgtacccatccatctacccatccatctacctacccaataaccaatccattcagttatccacctactcttttatctgcccatccactggcccatccgtctatccattcatctacctagcaaccaaggccttgtctccatccttacacttggcagacatttagttatgtggccccactcatctcagcttgggtctatgtaacctgaaaatccttctttcctttgagcctgtttcccagcctcccccttcacaccaccacaggtaccttcctctctctccagggagccttctggtcaccctgcccacactgagctctccggctttccattcttggactctacctccctgctaaaaacacactccagttctttagtaagaactgtctattgtaccctgccctcgttcagcctgtttctggttttatttaattgttcattcattcaatgaatcaatggaccatgtgtcaggctctgagccaggcatcagcgatggcgaagtggacaggcagtcacagcccctgcttgcagagggcttgtggcctagctgggggcctggaggggttgggggtgggggagatgacatctttcctaaggtgtcaaaaagacctggagaaatggcagatgggctaagaactgaagatgaggcccccctcccaaatgaactgaagcaccaagtcctagtctcatggctcaaattttgactgttccaatttgcagttgtgtggccttgggtaagttgcttaacctcatgagctcctgcttccttgtctgcccccgaggggcctaaccacagagcttgccttagaagatcagcatgggctgaaatagtcacagagaccactaagacctgtgtctggcctagtgactgccaatcctttcccatgacaccaacaatgacaacaccagcaagaagtcaggcttcctgcaaattcaaccacctgattcacttctcagaaccagaaataagtgagtgtctcttagcagcagaaatgcagctgtgagctgctggggagtgtagggatggcaggaacaccaaacacgtgtccaacctcgaggacaacaggcagatggtggggacaaagcaggagacctgcctttgagcctctgctctgctagctattagtggtgaccttgggcaagccacttcatctctctcagcttcttcctctgtaaaatggagagcataaccctacttcttttaggacttgagcatgcaagggttggaaataatgtagatagagcttctggaagggctcagcttggaatgtggaagcccctgttggtgcaaagagctgggcccaaaggaaagaaggaaagggctcgtgagcacagacgcaggggtggagccagagaatgggtctggaagaggaagcatggagctgggtcttgacactgagctcttgcgttcctcgcctccctttctcttggcatttcctcaccacccttccaacatctttacagttggggcttactctttgccaccattggtcccccatccaggccagccttccttggctcagttccaggctcatcaaaagccttattcctccaggatggcccttggcagctggttgggagggaaaggatctcatggggtttccatacacactgaggggtgagtgactcactgcagctgggagtccaaggacaatcctactagctgctgacaaaacctggcttctgcctctgaagcgaaccaagccctgacggtggaatttccagcagtgggtgaaaaaccttcctagtcttcatcagttcacatatatcaaggacactccaaagatggaggtcaaatgaaacccgaagtcacagaaaaaggagagtaagaaaataaaagagataaataataattgtctccaaggtagacaaaagaaagccccaccaggcaccttctgtgtgcaggaggagatggcactctcgctgagtctcccagaaggaactgtggccctttaaggaagctggtacatacaggagcctgaaattactgagcctgaaataagtcttacgtaaatgccaatttcttacggggcttttttgtatgtctttctttctttatctctctctcttttttttaaaggtatgatatataatgggttccttttgcagaatgcagcctctacttgaactctctcttaattaaagctcattgtggattaaagatgtgtggcaattataccttagatgcaaatacatttggcaaagggcagggagctggacaaggaacaattcctcattatgctgcatcccggtattcaccgcttcaggctgggggtggtgggctggacctggagagggtcactgggggctgaggggaacgtaggtctggaatgaacagaagcccgcacactcttctcttgtcaccagctgcctgctcacctggctttctcagcattgtacagtgtcagaccgggagggcacaggaagtctacccatcagatcctttctcctcccagagaaagagccctgaggtcagcagagtggtgcagggctgcgccagggcatcgagcatgaggaagggaaggccgggtggtgctggggcacagggtggcatggacagggtacgggggtggcatatagagtgtgtgcgcagggctgcccatgccacatctttcccagcgtctctgcctgggtgggccctcttctgtcctcttggcacccagccccatcccagccaccgctgagggcttaccaggagcacgagaatgatggggccttggtagatgtagtccaccaggtcgccaggctccttgccaaaccagcacctgtgaagatggggtggctgtagggggcctcctgagctggaactgggggacccccacagacttgggcccagggtcctccagctttacccttcctgagacccaatctccaggactgccccttcccagaaagccttggtggaaataccagctccactgaccacccttacccaccaggctgtcttttgctctacatggtgggtctgatctccccagcccgactgaggacaggccatgggtctctttctcctcctcttttacctgccccattgcagactgctaggcataggactgggcatgcaggaggcacaggaataaagggagagctgggctcccccttgctggcccagggccaattgccttaggccacctgttcccatattgcttgaaacccgctgttccgtgtgccaggcactcactcggccacacaaagcagcagatgtggaagtggagccttcctacctccagcctgggattttgcgtctttgagccaatgcttgtgcacccagtgaggggagctgctgcctggctggcctcactggctgccagaggcataattcattctccggggatgctggtcaggggaaatgctttagggtctgggtcggccagcaactactggaccacagggaggggccatcaactttggggaactcattcctctgaaatcttggaggtcatccagtgcagacctgcctcagataggattctccctgtctcccagggtttctggcctctgcttggagccctcctttgacaggaagctcaccacctaccaaggcagccctcttcttgggcagcttttactcttacaagctcttcctaatgttgagctcctggaactctactccattcttgcccccactctgagaacagatcccctctgctctctccaggctctgagacagaccccttggagatttgcatacaggctaatgttccctggtccccgctgctctcagctggtgacacctgactttctggctgctccttggctgacccatggccagagttgctgtcatttgggctgtggctcagcatattacagcctctggcatagggagaacctcaggatgggacactgcacccaggcagagactgagacttcagaaaaaaaaacaagctctgttaaatgctcatggactctttaaatgctcatggacagctctggatgtcatgtgcggccttggccccttccacataccccgggccagagctgccacatccaagtctgaggaggccttacaaagaccaaaggggtcatgcgttgggtcggggggcacttcaaggaaccacaattcctaacttaattcagcaaagttccttgagccctaccatgtgagtacctctgagtgcaggactatttttttcaatttaaggacaacaggaacgtggatctgtctaggtgtggctacaattcctgctccacggcttggccagagcccaaggctgacctgtcctaacacccccattcccttccccatgaccccccatggctggcccatccacttactgttcattctcatagtagagcttgccgatggcccaggcgacgatgatggggaaggggatgcctgaaagaaggaaagacttgggctgcaggggacagatggacagggactttcttgtaggacataccgtggggtaccacaacagggctaggatcatgtttttactcttccaacagcaggccacccacaaccccaggggtgccctgtccctcaacacctggcccatgcccctgcccctctctccaagcagggctgcgtgattttgtgatagagaagtagagccagccagtttctgagccagagacaaaggcctttggacaggtccttcctggcagggggagaagagctatttgaggaatatcctttggagagatcctttgcttgttcctcaccagcatggagggaagtagctgcatccaccggactgcgctgggggtggagggcagggccaggctctggtccttggacccaagacgaagggaaatggcctggtgagaagtcctccccccaactaggccctgctgcccctgggaccctcacaccatccgatgaagaggaagaggcacttgcgcaggcgctcagtggagtaggtcatgacaatggccgtgtgcaggtagcagccttccacaaacatccagaagaagttggtcaccacgaagtagttgaagatggtggtgatgcagcggcaccagacctgtgtgcagggcagagaggctgtcaggaggcagcttggggcccaggtaggacatacccatccccaggcagggcaacaagacacagggctccccaaagggggttcgtggacatgccatcaaataccagcgaacctcactctgaaaagcttcatccttctccagtgctctttcacactttcagattaagttaaggtgccattctccactggggccaacgtgttttttttaacttctctctaactctttctaatttttcattctagtaaagagagcaagagtctggctctgagctttctgtaggcagaggctggaattcaaccatcttgttgtgttttcattttagtttttttgagtcattttcaatccatagcaagtcagacctgcttccttttggggatgggatatggaatttcatttagaaaaaaatgaaaaaataaaagtgagtaaagtgagtcaagggtgtatgaagtggggctgcggccagggaggggattctccaaagactctgggtttgggaacttctggacttggcacaattattactagctctggagggagacttgcaaagtacacggcccccggcaagtcactgcacctctctgaacctcaaaaagtaaccctgccttccagggtggttgaaggagatagaggatggcaaagacaggcatgagggtagctgtgttgtggctgtggttgtgcctgctgtggttccgtgccttcccagcagaggggaatgtgtccctgtccctctgagcaaggccacccttccccaggcaccaaggctaccttcccaaaggaggcagggaggggaagaccctgcccctttagagccacgcagtgggccatggcagggccagggtctagacattgggcttccaggccagagctcctctcaacagaccccacctggtcatcttccccacaggctcatccccagggcaccctgagagccaaggctgggacatggggaatgatggagccagctcaaggtccggggagctgtgcgtcaggggctctgcttctgcacacagcccatcctctctgtctggctctgacagccccagttctcagataaccctcctgtgctgagctgttggctgcttctgggcttccctgcacagtccctgtggctggctgtctccttttttctgagaaagtcctgctgaggtgggaagctaccaagcccctcctcccaaccctacttttcatccagggttgatgatgttctattagcacaagcccacgttggagctagaaggcaccctcaactcgagtgaacctgtttgattctgaggcagtgttctatgtgggaccatgttaaggatcacaccaggctggtgtctgctcaggcacaggccacccaaaggaaatgtactgagaagtctctgtcggtgtgccacagggctctgtgatggcccaagactagtctacagttttacaatagcttggacacagtacacagcaatggacagaaatccagagtggacagttagcatgtgggatagccccttatgtagaggtatcatcactgcatgtgaccttggcgagtcacttaacctctgtgagtctcagtttccatgtctatgtaatggggaaaatgatccctgctggtctcattaggattaagtgagagaaagctcaacagaggttagttctagcttccttttctcaaaggggtctttgagggcacctgaatccacaagatgaggagtggactaggataaatgtgtctagagtcagctttgtgaagctcccagcctggcagcttcctgctcctcccagcccagctctgttgggacaatggctagggtggaggtgagctcaggtctggttttgcacctgagccacagcccagatgacagcattctggccatgggtcagccaaggagcagccagaaagtcagttgtcaccagctgagagtagcagggactggtgaacatcagtctctgtgtgcaaatctccaaggggtctgtctcagagcctggagagagcagaggggatctgttctcagagtgggggcaagaatggggtggagttgcagaagttcaacattaggaagagcttgtaagagtaaaagctgctcaagaagaagagggctgctttagcaggtagtgagcttcctgacaaaggaggggtccaagcagagaccagacagacagatgggtgcccccggagcccagagccccccaggtatagccccgagtctccccgagcaatgacctcattgctctcgtgcacttcatggtcaacgagctgcagcaggaaccacatgacatttcgcaggataaaggtggtgatgaggttccagtgaatcacattccgcagacagcgaatgctcctgtgggaggtgcaggtcaggggtcagccaggttcaggggtcaactgggactgggttccccctgaggccaggtagagactcagcctgggatgagggcagggctgcactaggagccacttcccacccatggtggccacagttgggcctctgagtccagctcccactctgcaccccacatgcctgctggtgattcatgccctggcaccccacccaaaccccactttctccacgggcccttttatctgctgggccccagaatggaggtgagaatgtctgggagaggtgaagggggtgctgtagggggagggatgaggagaaagcaaggcggaagggcagactcaccgcagggccaggaaaagcaggaaggcggccaccagggctgccacagatacgcagtggcccaggtagttgacgacaagggcgatgcggtagtgcaggtcatacttcctctgctggacagacagacatgggcagggcagatggaggcatgggcacgtgggggtggggctgggtattccagccgtggccacctctgtgtcctgaccttgggggcagaagtgctccaggtgtcattgccgtgcctggctcttagggttcgttcctgttggccctgggtggctcttgttgttataaatggctgtggtcaggccttccaacatgcatttatttttatttttttagagatggggtatcactctgttgcccaagctggggtccagtggctattcacaggtgtgatcacagtgcaccgcagccttgatctgcaggcctgaagcaatcctcccacctcagcctctgaagtagctgggactacagacaagtgccactgtgcctggcaccaacatgcatttttgggggcacattttgagaggtatgggtacagattcttttttaaaattctaggctctagaatgcttctcctgagtttagtctcagcccggatcccagctggctgagtgactgagggtgagtcgatttttatttctggacctcagttttgatgtctatacaatggggccaacctgccatcctacctaagaagcaatggcctatgggaggcctggggtggggtgcattgagattagtctgccctggagaccacacgagggggtgcactgtctatagagaatttagaaattctattcaaactgaataaaagtcagttgacttttaattatcaccaagtgttggcaatttgaaacaaagttagtgatgaaatactccttcctgccagggagagccacccctccaccctacccaacccctgtgttgattctccactgctggaggggcagagagagtggaggtgaggaccaagggctggaggcccccctgcccattgagtggcctccctgcagaacccctgtggctcacattttgcagaatcactttctcagggcgggtgaatgtttttccctctcaatttggacttcatctggggcaaagtcccagccccactgaggactatgctgggtaatgaggaggggatggagctgagatgtatcctttcaggtcaggaatgaggcgtagcctcaaggagaggagttcggtgcctcagcagcactgaattgaattccagagcgagagctggagcagggctccagagaggcagagcaggacccagcttctcatggggacagcccttggggggctgcatttgtttccatgtggagtcacagaatcagaatgccagatggggaaactgaggcccagagggagaggaaggtgtgcagtcacacaacccctaagatgttaggagcattgattacacggttattccctttttgtgtcacatgccaccttggctttgtcctctagcagcccaagctctcttgaaggtaggactccatgtcccccttctctactcccctacagtgtcactaagcacagggcaggacactgggggcaggggcaggaggtacagaagggagtgactgggtgacaaaaggactggtctgccccccttgggatcttctctgctcaacctgagtccaaatacctgtgtgaggcctggggtcacagcaggtgagggccactcaccttgtcatccaaaatgggctcacactgtgagtagttgatctttgaggcccacgtcccattctccaagcattctcgataggcattccctacaaaaaatgccaactgccaagagtcaggtcactcccctcctcaagaaccctccctggctccctggtgcccacaggataaggtgtacgcacctcagctctcctagggcagcaaatacaatgtgcatctgaaagtttacatgtaagtcacttatgtgaaaatagcacaaaaggctcatcttacaaaatagctaaaggcatgctaaaacccattttagacacaatctttgactagcattttgtacactttcattttgttcatttgcttcaaaactgaatccaactgtgaggagtgggttgtgcctgaagattcactgctttcagcatgccacataatttacatccttgtctcaattgttttatatttatgaggtccatacttcaccaatatcagcacttccatttttataatagctaccatttatatagcatatgtttcccatgtaccacttcctcttctaactgctatggatatacatgtcaattcaatctccacaaccatcccatgaaggaggcattaatatgaacccatttcaaagaggaggaaactgaggcataaagagattaagctactggccaaggatacaaagatgacaagaggattcaaactcagaagttgtggcttcgggtcttctgttcttaacctttaggccatatcaagtagtggcaaacaggaatgagtgaatgctggggactcagggctgggccaccgccctcgggctgctgctgcctgggaggctaccacgagatgtttctaaatgttcaagaaccagcctctgtatttaagttggaacatgatttaagtgtgaaaagacatttcaagcagcaatgtcctgtgcacaaaagtgcaggttttgtcaagggggaaggtaggaaagttaaaaaatgctcacatttgcctttctctctatctcagctccaactgtcaaggtctggctcctaagccaccccctccatacaccagctccaatcaggaggaagccctcccacctgagaaggcccggagctctcgaagcctgcctctgcttggccttcatcactagtgtgtttctgacctaccgggtgggttacaaatgctgaacgttccattgtttgggggtgatttgtaccagggttcagctctctgactaatgggcagttgtctgtgaatttttctttctagcatatgttagatgtacaatgtaaagctaattaaaataaatagcttgcagagcacagagttgcagagctggagggggaaccttaggttgtttttggaagcagtgtgttctgaaataattaagttacttaaaaacccacttccgttgagcccgatgagttggaagcaatggaattgggaaggagcacttgccgaagagcaaaatcaatggggaagattctattagcttaattgttttttagtttggtgcctggagctcatccattcttcaaacccagggacgtgactggcctattccttcctcctgggccaaggcccatccctggcagggccctgccatccccctgccaagtgagtcagggaatgccctggtctgatgctgattctgactctcaggaagaggaagcctgctccccacccctagccatggcgcccaactccccaggtgggatctaatttgatacctagcactatctttccttaccaacattcgtgctcatgaaagagaaaggttacctcaactcgtgagggtcagtgatagtgatgtcactgaactaaaaaagcaaaagtatgtaaggagggtaagttcttttgtgaaatgaacagtccctccctgatgggggtttacggtgcctctgaacagtctatgtgaggtgaggcagaccaggatcctgcctgtgcttcaaagggcagaaaaatttatcttctatatgttcatagatattatccagctttcctgaagctcagtgctaggccccttccttcaggaagacctccttgattgcttctactctatagctctctctctcctgagcacctccagtcctgaccgcctgagccccacactccagcccttgccccatgaccagcctggagctgtctaggtgagtgagtctggtcactctgatcaatgtgggggctccctgaggacagggccttggaatacttgtttcccgaatatgatatctcatggtggcactgatcatggggtgggcttgcaggtgggagggggtcaggatagaaatgctgcaaatcagagacctttcctctccctcacaccaatgcccatggggtcccaagttccatggattctgtctcctccttttctttttccagagtcaactcccctcctgcccatccctccatctgctctctagtcttcttgcctgggctgctacaacagcctcctctcctcttgcctccctgcttcttttcttgccaccttgaccatgttgatttctgcttaaagccatcagtggctctttattgtgctcaagaataaagtccaatttcttagcatgatagtcaaggcccttgacacccaggtcccagcctaactgtcctgacccatctccagcattctacatggccactggcattggcacacataggtttggcacataccctctttgtgtggatccaccacttaaagcacctcctccttcttacccactgctcacggatgaactcctacccatctttaaccccacactcaaatgccgcctcctgcatggagccatccccgacacccttaggtctgaagcagtcctttctttgtttcctcctctatcccttcccttctcttgtaacgtagtttttccactttattgcccttgaaccacaataacacatacattttatgttataatccagtacacacacacacacacaaacacagaatccagctgtactattttcctttccagcctattctaatgtcttctattcatttcacacacactgatcatgacccactaaattgactccacagtccactcttgtgtcacaatccatagtttgaaaaatacaaattctgttttagtgcatttgccataattcactatgaacttcatctctttggacctaatccttcttttctttgctactggacttgagctccttggggatagacaagtaagtagaagccatattggagccaccatatctccctcaggacagagccattgaggaaatgtcggctgaacagaattgactcagacctgctgacccctgggaaagcaggtgggatgcagaagcgggaggggacttccctctctggcagcccagccctgcctgcagatgagcttctggttacagacactgggtatcaaaggactggaggatagatgtgccccactcttcaggggagctgtctgctgtggccaatgagggcactgggccctcaggcacagcctcggacaggagggagtaagacagaaagaatctcatccaccccgtgggaaacgtagacggatgggcacacactctgagggctgatggcaaggctagaattgtggggctggatgcagagaggtgggtgcccattaccatagcaacacaggtgcccctgctgaggatcagtgctgatgatgtggagtgtgggcttccaggggcattagggtctgaatgatgcaggcagggtcttctcttgcaggactctgtagtctgggaggcctggtttccatgcccagagtggcccaggcctgccaaaaacccccattacaatgggctctccccgtttcagatgctgacactttgcaaagagttcctggttcaggcagttacctggggtggtcctgaagcctggctgggacatgagaccctatattctagctgtagttttgtctctagatagctaggtgaccatgactaagccccttccctcttggtctcagttttgcctcttagaaatattacagtaaattgattctctatgatgttattggcatctcaggtggatcaattatatgttatgtgagactccccagtctactaaatgccagttagcaccctcaagctattgtgacaactccaagcatcctgacatcaccatcaaatggttggcacttctatctctgataccttctggaaagacatggaccataggagacagggaccatgagggactacttttggtggtagttttgggggaaggagtacaagggacaggggtaggcatggggaaaagagttaatgggactgtggtaaggcacaacaatggggtcattggctatttgcaaagaaaaggacaggaagtgagggagaggctggatatggtggctcatgcctgtaatcccaacattttgggagaccaaggcaggtgaattgcttgagcccaagagtttgaaactagcctgagcaacatgatgaaaccccatctctcaaaaaaaaaaaaaaaaaaaaaaatagccaggcgtggtggtgtgcgcctgtagtctcagctactcagaaggctgaagtgagagaattgcttgagcctgggaggcagaggttgtggtgagctgagattgtgccactgcactccagcctgggtgacagagtgagaccctgtgatgatgatgatgatgatgatgatgatgatgatgatgataatgatgatgatgatagaagaagaaggaggatgaagaggaggaggaggaggagaagaagaagaggtagtactagtagtagtagtggtggtgagggagagaaggtgatgacattgaggtggggagggccagaagcaatatttacagaaggaatgaagtcactacatgggatcggaactttcagcaccgcggacagcacaactccattcttcatccctgcctatctctaaggttggggacctcggagagctcctaagaaccagccttcccacccgatattccgaccttggccatgggcccagcccattgaggtcaagctaattcatgccccttttcaaggcccagctccagccccagctcctccaggtagtttccatgactgttccagctccccaagggtccagctgcttgtgactgcctggctcatgctaggctgggattgatctttcactgacccctataaaggtgttgtactttcctaaccagcccaggttctctggagcagaagtttaccttattttgtacaaggctgagagcctctaaaggcatgtcctgggttgctgtcatctctggccttttcttaagcactgcacagagctgagcacacaggatctcaggatggaccaaagctgatgctgtttcctaggttacttgggaactcattgaaggtaggaggctcagagtgggccaggaggacagtctgccaccttgtatgcccatgcttcaccaagatgcatggcaaatacaaaacagtcacacatacatgcaggaggaagcaaggtctcacacaaagacaccatgggtaggctgacccagctgccaaaactgcagacattgcagtccaaccccacatgggggaggggtgtcagtctcaaacagcaaacctgtgggcagcattctccaggttcctggcatgaaagctttgactgttccaagggaagcaagttggaaactgagttatcaggcatctccttgggaattaggaaggaagacaacttctgcatttggtctggtgggaccagaagagagaaactgacacatctggggtcactcaaccatgaagaggcagaagatctctctcccttgggacacgcttcctcacgggagaccctggagttggtgtacctaggagagacagactctccctgtgaccctgtgtttcagcagatgcagccagttatgccacctcttcagtgtcattaccacttggtgtccagatcctcagaagagaataccttaggggccagatatcccaccctcagttccctttactgcctgtagttgggccactccagatccagccatcttcttgtctggcctggggcctagttgagaaatctttgaccatgactttgagtcacctttcttacctactttttttttttttgagatggggtctcactctgtcacccaggttggggggcagtggtgtgatcttagctcactgcagccttgaactcctatactcaagtgatcctcctgcctcagcctcctgagtaatgggactacaggcatgtgccaccatgccatgatcatttgttatttttttgtttgttttgtagaaacggggtctcactatgtggttttggctggtctcaaactcctggcctcaagtgatcctcctgcctcagcctcccaaaatgttgggattgcaggcatgagccaccatgcctggccatctttcttgctttctgtgggaaaaacctctcaatcaatgtctcctcccagcttggcctccacttcctggagtggattgcttttcatccccagttaagagacttttggggaaggtggacagagctggggtggtcagacgtacagtcctagtactaacagcatggttttcctgagcttcccaaacgaggtgcatctccttgagtcagcatcctgcattgcttggaggccactgcaggttaaggaggactgaccaactttgaggcccacctggcatatttctgtcttgatccgatcacagcaaattggtggtcagaggggaacaggcagctggtgatgttcacccaagctcagacccagactgacgtagaagtgctagattgagtttgggagtctaatattgccaaccccagccactgggtgggaaaggcatccccagggccctttgctggtgctgtctgggattcaggccagggaacttggattccatttcttagtgttatatggacacagctctctgagcctcgactgcctgttctggaccttcagagaccctcaactccctatttccacaggacttttcactcatggtgccctgccatccttaagcaggacctgtaagcacacttacaggagacagtggggaaactgagtcatagaggcactgagcagtttaatggagaccatactgggtctatgaaaaagggaagggggagtggaacccagctcactgtgtaagctctgccctccccagagaggggcagtgggaggaggcccctacctcatgctcccgcctctactgtacagggctccctccttccagccatcctagcaacactcagtgggctcgtcgccatgacgccagcctgtggaggaaagtggggaggggaccaacacaggacccctgtggcagaagctgccttggaactgagaaacatcactagaactcatcaagccctccacccacctggtgcagatgaactgaggtctgaagaggggagaccacctgcccaaagggagaaaagcagtcagtaggatggccgggattagatctggctctcagttcctagttcctatgaagtaatgcagggagaagacagctggctggcaggatgccagcagcatccctccaggggggcaaggggctgcctttctctacaggcttttaggtaccagaccttctcaatctagatagacagaatcctccctcccaggacatccccagaagccacagagttctgggggctctcagagatagcaggagaccaccaccccagaatgaggatagccattcttggtgtgagcaggatttcccctacccaaggacatgatggcccctccttccaggccccaggccaccttcaactcccctccccttgctgacaatgccttagctgtctacagggagccccaagcagcatcatctcccctgtgtgccatggccccacgaggtcagcatgttctctgtccccttcacacagataagaaaactgggacttggacaaggagggcctgccagtccctcagtgagtcatggcaaacccaggacttagatccagccctgctaaatctgagcccaggttcctcccactctcccttgccccagctgctctcctggcaggtgctgtgtgtgaaagggaccgcctgcctgactctgaagcacctggtgagggtgggcagtcagaggggcccaaatgcctgtacctggggcccagccaagaagccctgtggggagctccctgaggatcactgagatggggctcctccttcagcccgtcttcagggctccaggctctgctgtggcactggtggtaaggagtgcacagggaaggatgctgggacctctgacttaaggagcaggtgggaggagaggaaagggccaaggcccaggtccccagccagcccttgattgagatttagatggcacattttgaaaagcagtatccttccagagtattctggtcctgtgccatagggctacggacaagcagccgctgtctctaaagccagcagaatcgaggcccatgccctggtccaacatttgaggcctccatgatctggcttattcttccctccctcctcttccacttccgctcccaccctcccttccatctgacacatcattagctcaatttttcaaggcactgttcaacaacacttcctccatgaagtcttccaaatttactttcccttactcttggaataactcccttccatgtgctctgactgtcttcactgtgctattttacttgggagcctatatcaaaaagttctctttgagagtctgcctgtctgtcactcttcctagaacaggagcccctggaaggcaggctcaggtcttatgcatctttgaaaagcttgtctctaggctcctcaattctttctgggggaaagggtaaaatactcagaaccccaataaggggtgagcctgagcaagacgatcaggtggctggaggattcctggggagagcaggagacaggaaagatcaagatgcatgcagaggtgggtagaagctagagcagaagccaggagttcccagagccagcagaggcctatcagggcccagacttgctgtagaactctgagcagctgtgtttccctctcctggccagtcatttcctacccttaagtggggaggggaaggctggactcggaacatagagcgctctgcagccgggcagctctggggtgtctggatggccacaagggcatccacttctgctctatttctcttccttccttcttttcttagctaaacctctgtgatggccatgcctgtcccaccttccctctctcccagcagggaagttgttctcacacatggagtaacttgtggcccttggagaatggaatagagtcaggggggatcaggtctcgctggagtctgagaatgcagacctgagtttccggatttacagcttctacttcttcaacccagagggcagggtctatctggggtcctcctgaggcttgcacccctgcactgcgcctgtccttaacaaatgtggcatcccaactgctccaagacctttaaagtttacccccactccctccagaaagcctcccaggaatgtcccagtgtccaccaagcccctcttcccgatctctgactgttgatttgcacaagcctccttgataagcagcctggggcttcctgagggcaggtctcagcctttcttatcacctctgactcttagggctgaagaagggattcctgcataagcaggcagacccaatgggagagacccctctggctggagaccactcagcttatgtgtttccattgtaacacaatcagtgcttaagcatgtctctagaatggggttctgggaagtggggacccctaacctccccatgtggctaggttagatgggatgccccttcttcccctgtcctggcagatgcctcagtacagatgaccccagccattcccagtaggacattgcggagcttgaggtcaaggaggctgaggctcagccaagctgcacttagtggttccacagaaggaaaatggaccatggccaggagggaggtggcaagaccctcctttgcagccaaaaggaccgtagggacaggcaagatgaggtgcaggaggagggcagatagaaggagggatgggagtggggagacagtgggtttggagatggagtcgggggatgaagaaggcagtagggagagatggagaaagagagagagaggtagaaaatgagagaatctgagaaagacagaaacatacacccagaaacagaaccacacatagagaaaatcagaaacagacagggagacaatgagagagacacagagacagagatgtacacacagagatgggctcagaggagtccgtgtggaatggggagaggtgggaggaaaatggaatataagtgccccacttctggccaaaccacttccatgctaatccacttcctttcggcctacagacagggagacaggcccacaaaagggatgagacttgccccaattaaattgtatatggacatttaggattgtttctagccacccaggatttgaacctgggttcggagaatcctggggtaagaccgaggctacctccccgcctagagctaaaatgccagatccttacttcccaggatcccttgtagccagagctttggcatgggatttggggctccacatattcccccacccatcagatgcacctacccgagggaattagtgaactggaggcccccagatggagacagggagaaagcctctccagagataactgcaggaagcttaagactccaggttggccaggtgcagtggctcacgcctatactcccagcactttgggagccagagacaggaggatcgcttgagtctgggagttcaagaccagctctggcaaaatggcaagatcccaactctacaaaaaatttaaaaattagccaggtgtggtggcatgtgcctgcagtctcagctactcgggaggctgaggcaggaggattgcttgggcacaggagtttgagattgcagtgatctttgatcatgccactagtggtggccagggctggtggtgttggcagggcctttcagggagagggaggtcccctcacagggccagctctgccctgtgttcttggcttggggccccaaatctggttctctagcccactcagtgattccataagctccccaatatctttttaaaaaatttcttctctgcttaacctagcagagttgctttttgaaaggcagcagaacctgggtttgaatccttgttctgttacaagtgacttcattgctccacacctcagtttccccatgtgtaaaatgaggataatgccatgtctctgtcactcgatggtgcaaggattaaatgagttaaaccacagtacaaacatgtggaagctcagccactgaagcgccagcacaggttgtgtagagaacacccaaggagactcgtgtgcttaacttggctctgccactgactaacatgtgtggccatgcgctagtcccttcccttcccttggccctgctgcatctggaaataactctgggtaagatggctcaaggctctgacccagcctcccaaactcacacactgtagctatttgctaaccccacatcctgaggacttctaaacgccttatctccactcttggtgctctcttgagcttttcccccacccaaccagctgcttcctgaacatctccactcagctgtccctccagctcctcaaagtcaacacatccccaactgtgctcagctgtttcctgtgtgcccaacctttaccttgccatctctcaccatatcttgtcaatttcaaatgcccaaggttgctggcgtcttcaacctcatttgctcttacagcctgcggtctacctgggtctgtgcagaaatccccttacttctcctttccctccagaggacagtgtgctcccaaaattgagcttctctgctcacaagctcacccaggctccctctccagatggtgaagccctgtagaatgccctgcatcacctgacctccatgcccctccccagcctcattgtttctttctcctactccctgttctccatacaacacactcctcccaaggcacaaagcccagcctgtctccttgcctttgctcagtcccctcagcctagagggcctctcctgtgcctattacactcacctgctaaaatccaacctgtccccagaagtccagctcagagggctaagtcctccctgatcctccaggccggaggtatgagtcttctttccaaacctctaagctctcctcgcaaaccgaatgcctcttgtggagggagtactgccccatggttaatagcgagggctgtggattcacctgcctgcactggtgcataggagctgattaggactttcaataagttacttcatgtgtctgagactcagtgttcttgcctgcaatatgggcataaaagcagtatgtatctcagagggagtgtgggcgagtgggattatggatgcctgagatatggatacaaagctctctcagtggtagctggcacctggaaaatgatcaacacttagctttgtggcagattctctgtgctcagctgagttgaaaaatcgcagagactaatatctaaactgctatccccacccgggcgattcctgctctctaaggaatgaggcttcaatgcgggtttggctatagcataacaaaattggggcaggaagtggagcctgaacgctcctgttcttcccctaggcttctcgtggaggtttctccctctgtcattctttttaaaggaaggatcccaaggaaaaggcaaacagagaagcaggaagcagcactgatgtgaagaaaggggaggagggaaatcaatcatgcatttccacagccattagcagcctctgctcttcccacctaggctgacctcacaccccaggtgctggttagtggtaagtgctccccaccctccacaagctcctctcattctccagcagttgcagtgcaggcagcactttggtctaaatgaagaaaattgttcattagataccaggggctaattggccctacttttaccagcctgggtggtgccccaaccttttatcagcttctcattagacttaattgatatgaatggcctgatatgtgctgtctgcagcacctttgggaagtcttccttgtcaccccgcccccacaccccaatcccatagaccttgtgcttcccccctaattagggcattcatcattctgttctttttgtctgttgcaattgtgagtgagagcctcaatacagtgcctgtgcagtggctggcacatagtgggtattccacaaattgactgagtattactgtactcagcttggctatgaagaagagacccaggccctgggaagggggggcccccaggctggtcggggagaacaaggcatagcccaggctggggtaagaacgaaagcagagctccctgaggttcacaggctgtgggctgagatgctccatcaccccactttaccctggatggcccttaatctccgggcccagtctgaatcaggcatgctgatctccattgccccaccccacacagctcacggaatcctaaaaatacagttttataaggtcaggactaggaaggcacagggaaatcattccttctgcttgcacacctcctagcttggggatcttacttccttctagggagatctgttttaatcatggatgggaagcatgtgctccctgggcccaccagagccctcagctggtgcagccaggagagtgcggcttggcatcaggtgcaggtacatctctcttgccttctaaccatctctcatggcaaagccctcagcctcagcttctgaaagcttgtgtgtgtgtgtgtgtgtgtgtgtgtgtgtgtgtgtatgtgtggtggaggtggagctgggctaccaatcagacacagacactctgaggatgtttccaggatgagaggcttcagacaaacaatccagatagggtctcagcgtgcttgacaactggggtccggctggagatatcaggggggttctaggtggggcagtgattgctgcccccacagcctcccgcagaccacacacctggctcccatcccatgttccacagggcacagacaggcacctacccacacgcacacacccagaacccacactgaacgaccccacctggaggctgtgtaactccagcaacctctactgcccttttccccagagcctcaagccagtccatgatttgccaggaggaaggcaggcacaggttgttctccttgagagatggtgttggggtgctgattcagacaccactcattatgggggcgcaggaataatgctgcccacagcccctgactcagcccagcaggtcagtcctgggacctcggattagggaagatgcaacaccccgcaccctctggcttagcagaacctacgcctgcatgtcctccccacgaaacatgcgctcgccccagccctcctgcctcctaccctcctcctcccctctggtagtagggtctggtcactgcactcactctgggggatttgggacttagcatatccgccctcctgggataggtccccctcctgggcaggggaagcattgtctaaacaatgaagccctaatggggaacttcaggcaacgggaacctacaatgagggaaggaggtttacactccaagaggaggaagtatttccttctcccctttttgggctgtcaccgcatggagcacgggaattgtgggcaaatcactggcttactgagattagacgctgtattgggggtagaagcagaaggcgcgcccccaacactgtaaggggtccttaacgcccgcggtccgcggtaccgcggccgtcagcagctttgtaccgctgggtccggaatcctctttactccctaaaccgccttctcaggaggccggtgtagagcaggcagcgagggccgggggcactcacgggtcgtgttgtacttgacgccgttgaagtactcggggcacggcctctccacgagggctccggcagcgctgcggggccagcacgttccgatctggtccaaggtcgtgttgcagtaggagtagggacctggcggcgggagagagcgcagtagggctcagaggggcccgcagggacgcggggctctcggagcgcggggtcaggggcgcacccagcgcgcgagagaaggagcccgcgcagcctccgaccgctcgcctcccgcctaccctcggggtccaggggtggcccccagccgtccaagagcagctcttcagccagcgccaggctgcagttggcctccagcaggctgtggagcagtgccgcgtccatcgcgtcccgcagccgcgtgcggagagggagtgggagtgcgcgcccggcgtgactgcgagggagtggacgcgagagtgagcggccgagagggcgcggggtcctggcccccgccagcccagccccgatctcccgggcagcctttgggcgccacctccggtcgcccagagctgtcaagtggggaccttcccggagaggagccgccgagtgcacggagctgcgggtacagccgctccgccgcggccaat

SEQ ID NO: 131 - DNA, 30583 bp, Homo sapiens; identical to SEQ ID NO: 130

SEQ ID NO: 132 - DNA, 30583 bp, Homo sapiens; identical to SEQ ID NO: 130

SEQ ID NO: 133 - DNA, 48161 bp, Homo sapiens
gtattttaaattgttgcagcagttttatttaaaaatgtaaatatttacaaaatggcagaaatcacacctttgaaggatttaaaacttaagtaaaaaatactacatgtcaacttaaaaatgtgcaagacgggatacatgatttttcaaaacttatttttgtagggggtacctagagcattggtttcttttggaagaaatggcctgatgcttctctctccctgactcctgcggctccgctgcagggacacagggacggaagccaagcctggaagctgccctggtggtcaactgaggggccatgtctaccctgcccaccagattccagagccttggcctttgggacaggccctggcttgctggatgagctgcacacctcctccaggctgaatcaagctgcccttggttgggggctggggccaggtattagcctggttggagtgataagggacagacccgcctgcaggtgctttgaccataaagactccaaacctaccagaggtcagagagagagagaactggcccgaggccagggcccgagcccactaaggaagatggatgtggccccctcagacccagccacgatccttggcccacaccactcttcgggtgcctgggtgacttgacctgaggggaggccacttccaagaggcatggtttatttcacagagagcagagatgtttctgaaggggagactggagggcaaagggcaatggggtatgagtttcaatcactgaagacatggttggtttctgctattcccatcccacgcctccctcctccatgcctctgctcctcattttgccccgcacgatgcaactggttgactaaggatgtggcttccctgatggcgtcttccttgattgcctaatctgtggactaggcagagaaggggtctcccaagagaggaagccaggcctggaagcctgcatccttcatggagcccccaaggcgggaggatggctggggaggggacacaggaacaagggtggggtacaagtgagcctctctaggtgacagcccctgggataaggcagccaaactgatcctttgctggcgtaccccacccaactgcaggggcaccactgagtgtggaggccaagggccagtgcagggccacaccattgcctggctgctggctccatgagtagggcaggggagccctgtgtctgctactataaatagctgtgtgtgttggacaggtccttctctgctctgggcccagtaaggccctggccagagaggctgggatgggcaaatgcctgcagacatctgactggctcttctcagggggtcctgtgaattccctctgcttcctcttgcgctgagcctggtggcccccactcatccctgtcccttgcagtcccccttggctgccgcaccccctctttcctgccaggctggagagctggtctctcccctcccatctcctgccccacgagagcctgcccagcacagagaacccagaggaagaaggtggaggaggacaggggagctgtgcaggtgggcgaccgaggggtcacacagcggccgtctgcttgatgctgtggaagctgatccgtgtgggtgatgtagggatggacatggcccgggccatggggactcgaagggagtgatggtcctgccagcggtgccacctcttcctcacggctgagcgcacctgtggggaaggcagaggctcagctggctcccagggaccaaccctgggcttctgggaccatcccctcctctgctttctgctctcatgggtcgactgccaccctcatgacaaggaactgtctgcttccaaaacaggtccttccctgatgctgttgcctctctccaggggcctcttccttatccttttcctggagaagcttgactccacacctcctttactccacactgtcctcccagatcatccagtttcctctggacacactgccttcccttccctgactcactctgccacctcaaaattagcatcttgggaccagagagcgcagcttggagacttggccccctcagccttcttgggcccctgctccttgcagggcgttggtggtgtgcgcccagctcacacacctggtgcgcctcctcctccctcctgaagaccgtcccctctgcacccctccaccttctctacctcctgctagactcccctgcctgactaaccatggcatttactgcctgaaagggaaagctctctgtcttggtcatttctaaagttggctctacccggtgccatttaagcttcatttgtttggtaattgaatttttttggaaattggatggtgtctctcacatcctagcttgcacatggttcgaacagaataaatgctccataaacatcccttgtttgtttgccttactggccccctctcttcttctcatccagcccacaggacccgtctctgctgatggactttgcaagtggaatgtgctatcatccacagagacacaggcctgcatagacacctcgccagtgccctgtgcagagacaggcaagtgtattcctctggagtgttcggaagctcccaggccctaggggctgtgtctgctctttgctccatgtcctcatccaccccagcccaggtacgagtgcgcttcttccctgcgtcagctgcactggggctttgggcctcatgattggcttgcacatgccaagcttcacggccgcctgactccccagagcctgctcttggtgtgtgggcttttctgtggcaggtagcgggggaatgtgctggtctctcttctgctccctgagtccatacagacctgattgcttggcacacatctctttctggaagcttccttctgtcaccacctctgctctggcttctctcttccatgaggccctgcggcctgggcttccttgctcacccagctctgagtgcacatgtggggtgctggcatgttatttcggggctgcatagttgaccttctaaactggctccagcccctgtgagaaggattcctgttcccctaaggccgggtggtatctcaaggcttcctctccctggcactccagcaaggccgggcagcaccaatggagctgccctggagtggggtctgaggacctggatatcccaggccaccccgagggcccagcttcatacctctccattgaagaagcagtagaagacagacacgaagaaaccctggaaaggagggaaaggagggagtggtcagtgacctacctgcggagctgttctgcctggtggggtggcactggggacaagatggtgggggggggacaatttgacccaggaacccctggagtcagagctgggtggggtcctagcctcagggtgcagatattccacggtccactctgagtgagcagtggtcacaggcctggagccaggcagactccggtctcctcaatattgtgtgacctgtcccagggcatttggttgggctgcctgcatcctcagaacaggtgctgggacagtaggtgcgggctggtaggatgaagacccaggctgggatggggataactggccaggctcaggctgagcatgtacgggcttctaactctgtggatgtaactgagccatgggtgtgccagtcccacgggacccccttagtgagggcatggctgccagagcagcctcaggaaagctcactgtggggcccccatctggtcacaggccccacctggaacgactgcaggaaggagttgaaatagatgaacatgatctgtgacaggtcgtcctccccgggattgacgaagaagagcatgtaggtgatgcccaggaggggcaggagcaccagggtggccttcactgccttcctgggggcgagaggtggacacaggtctgagcccatgcggcaggcagggcctcacccagtgggcggcgggagacagtggtggtgtttcttccgggagcttgagcgagctccctgggtgaggcctggggcagagggctctgccaggaagcagggggacggcccgatgacctcctcctgtccccattgtggggtcaagggaccccctcacatacctgtactggattgtctcggatgtggtggacgcgcgtaactttgtcattaggatcctgacgatgttgaacagaaatacgaaattgatctggagggagggcgggcatgggaaagagggaaaaggaaggagcacgtgtttgagatgagccgagaggcagcccccttccccgcagacccctggaaaccgatgtcccacgcacacacctatcctacctgtccccctagcacctgccagcatcccaaggcctgtgctcctccctcgccaggatggggagacagccccattttccagggcctgtgtctccagcccaggactgaggaggaaaggtggcagcctctgtgggtcgtgaccgagagcacggggcatgccctctgaggctgagaaagcccccaaccctctccccagtatagggaccctatgggagcccccttcccctcactgccacggggtccctacttgttgactgcggggctctctgagtcccttgcactgtcactggctctaggtcggcctgaggtccttctgactgaggacagcactgccatggtggggcggacaaggccagatggagggattaagaactcagttgccgaatgagtgattaatctgccagcatcccacccctgtgcccaggaactccagagccttcgtaggcaccctagacagggaagatggatgggctgtggggctggctctgaggccccaggaagggcctcatttatcttcattctgagttttccctcagcaccagagcctccccacccagcacctggccctggaactggcctgtgtggctccccagctgctccctgctgggtgtgggtccccatgggcctgcgagtgtctgttcatctgtattggctgtgactatgactgtgttgtcccctgggagctgcagtgtgggtctgtgggtctatcctttaagcacttgtgcaagtgtgtttgcctcacagagcgtgtgcatgtgtgagcatggatctggggcccgggcacatctgcgtttctcttcacctgcctccgagcataggcaggcaggcaggcaagggagtgtgtgtcggcctgacacagtggggctgtttcctgacaaagtgctcgtgggccagagggagacacatgttagcccaggggtgtctgctggctcgtgtgcacacacccactcacacacacacacacacacacacacacctctgacactctgtcaagaaaatccattgcttcttaagcttgggctgggcccttctaaccctcccaagttctgaatcctggctgggagaggagggacacaggatacagacagatatcctgagactgtcaacctgtagcctctggatgctccccacaagctttcgggtagccctaggggcagggagagctcacaccccacctcagccactgtctactgctctcttaccacatagtggtatggcctgggggtcccagggagggctggggatggaaagccttcagcggggctgccatgacctgatacccccagctttctcctagggctcacctaatttccagctcctgggtctctggcatattcccctggatcatgggacacaagtcaccttaacatataagtgaatcctaattttctcatacaagtaatacaaagtatttgaccttttctgattcttccggacttccctgagagtagaaactgttggaatcaaaatatattctcatttctgccacattttcttgaattcaatattaatcttccaacatccatcaacccactaatcaattcaattatccacccactttattcatctatccatctatccacttacctaccaaccagttcattcatttacccacctacttttatccatccgtccatccatccatccatccagccattcatccattcatccttccttccttccatccatccatccatctacccaacaaccaattcattcaattatccacctactgttttatctatccatccacgtacccatccatctacccatccatctacctacccaataaccaatccattcagttatccacctactcttttatctgcccatccactggcccatccgtctatccattcatctacctagcaaccaaggccttgtctccatccttacacttggcagacatttagttatgtggccccactcatctcagcttgggtctatgtaacctgaaaatccttctttcctttgagcctgtttcccagcctcccccttcacaccaccacaggtaccttcctctctctccagggagccttctggtcaccctgcccacactgagctctccggctttccattcttggactctacctccctgctaaaaacacactccagttctttagtaagaactgtctattgtaccctgccctcgttcagcctgtttctggttttatttaattgttcattcattcaatgaatcaatggaccatgtgtcaggctctgagccaggcatcagcgatggcgaagtggacaggcagtcacagcccctgcttgcagagggcttgtggcctagctgggggcctggaggggttgggggtgggggagatgacatctttcctaaggtgtcaaaaagacctggagaaatggcagatgggctaagaactgaagatgaggcccccctcccaaatgaactgaagcaccaagtcctagtctcatggctcaaattttgactgttccaatttgcagttgtgtggccttgggtaagttgcttaacctcatgagctcctgcttccttgtctgcccccgaggggcctaaccacagagcttgccttagaagatcagcatgggctgaaatagtcacagagaccactaagacctgtgtctggcctagtgactgccaatcctttcccatgacaccaacaatgacaacaccagcaagaagtcaggcttcctgcaaattcaaccacctgattcacttctcagaaccagaaataagtgagtgtctcttagcagcagaaatgcagctgtgagctgctggggagtgtagggatggcaggaacaccaaacacgtgtccaacctcgaggacaacaggcagatggtggggacaaagcaggagacctgcctttgagcctctgctctgctagctattagtggtgaccttgggcaagccacttcatctctctcagcttcttcctctgtaaaatggagagcataaccctacttcttttaggacttgagcatgcaagggttggaaataatgtagatagagcttctggaagggctcagcttggaatgtggaagcccctgttggtgcaaagagctgggcccaaaggaaagaaggaaagggctcgtgagcacagacgcaggggtggagccagagaatgggtctggaagaggaagcatggagctgggtcttgacactgagctcttgcgttcctcgcctccctttctcttggcatttcctcaccacccttccaacatctttacagttggggcttactctttgccaccattggtcccccatccaggccagccttccttggctcagttccaggctcatcaaaagccttattcctccaggatggcccttggcagctggttgggagggaaaggatctcatggggtttccatacacactgaggggtgagtgactcactgcagctgggagtccaaggacaatcctactagctgctgacaaaacctggcttctgcctctgaagcgaaccaagccctgacggtggaatttccagcagtgggtgaaaaaccttcctagtcttcatcagttcacatatatcaaggacactccaaagatggaggtcaaatgaaacccgaagtcacagaaaaaggagagtaagaaaataaaagagataaataataattgtctccaaggtagacaaaagaaagccccaccaggcaccttctgtgtgcaggaggagatggcactctcgctgagtctcccagaaggaactgtggccctttaaggaagctggtacatacaggagcctgaaattactgagcctgaaataagtcttacgtaaatgccaatttcttacggggcttttttgtatgtctttctttctttatctctctctcttttttttaaaggtatgatatataatgggttccttttgcagaatgcagcctctacttgaactctctcttaattaaagctcattgtggattaaagatgtgtggcaattataccttagatgcaaatacatttggcaaagggcagggagctggacaaggaacaattcctcattatgctgcatcccggtattcaccgcttcaggctgggggtggtgggctggacctggagagggtcactgggggctgaggggaacgtaggtctggaatgaacagaagcccgcacactcttctcttgtcaccagctgcctgctcacctggctttctcagcattgtacagtgtcagaccgggagggcacaggaagtctacccatcagatcctttctcctcccagagaaagagccctgaggtcagcagagtggtgcagggctgcgccagggcatcgagcatgaggaagggaaggccgggtggtgctggggcacagggtggcatggacagggtacgggggtggcatatagagtgtgtgcgcagggctgcccatgccacatctttcccagcgtctctgcctgggtgggccctcttctgtcctcttggcacccagccccatcccagccaccgctgagggcttaccaggagcacgagaatgatggggccttggtagatgtagtccaccaggtcgccaggctccttgccaaaccagcacctgtgaagatggggtggctgtagggggcctcctgagctggaactgggggacccccacagacttgggcccagggtcctccagctttacccttcctgagacccaatctccaggactgccccttcccagaaagccttggtggaaataccagctccactgaccacccttacccaccaggctgtcttttgctctacatggtgggtctgatctccccagcccgactgaggacaggccatgggtctctttctcctcctcttttacctgccccattgcagactgctaggcataggactgggcatgcaggaggcacaggaataaagggagagctgggctcccccttgctggcccagggccaattgccttaggccacctgttcccatattgcttgaaacccgctgttccgtgtgccaggcactcactcggccacacaaagcagcagatgtggaagtggagccttcctacctccagcctgggattttgcgtctttgagccaatgcttgtgcacccagtgaggggagctgctgcctggctggcctcactggctgccagaggcataattcattctccggggatgctggtcaggggaaatgctttagggtctgggtcggccagcaactactggaccacagggaggggccatcaactttggggaactcattcctctgaaatcttggaggtcatccagtgcagacctgcctcagataggattctccctgtctcccagggtttctggcctctgcttggagccctcctttgacaggaagctcaccacctaccaaggcagccctcttcttgggcagcttttactcttacaagctcttcctaatgttgagctcctggaactctactccattcttgcccccactctgagaacagatcccctctgctctctccaggctctgagacagaccccttggagatttgcatacaggctaatgttccctggtccccgctgctctcagctggtgacacctgactttctggctgctccttggctgacccatggccagagttgctgtcatttgggctgtggctcagcatattacagcctctggcatagggagaacctcaggatgggacactgcacccaggcagagactgagacttcagaaaaaaaaacaagctctgttaaatgctcatggactctttaaatgctcatggacagctctggatgtcatgtgcggccttggccccttccacataccccgggccagagctgccacatccaagtctgaggaggccttacaaagaccaaaggggtcatgcgttgggtcggggggcacttcaaggaaccacaattcctaacttaattcagcaaagttccttgagccctaccatgtgagtacctctgagtgcaggactatttttttcaatttaaggacaacaggaacgtggatctgtctaggtgtggctacaattcctgctccacggcttggccagagcccaaggctgacctgtcctaacacccccattcccttccccatgaccccccatggctggcccatccacttactgttcattctcatagtagagcttgccgatggcccaggcgacgatgatggggaaggggatgcctgaaagaaggaaagacttgggctgcaggggacagatggacagggactttcttgtaggacataccgtggggtaccacaacagggctaggatcatgtttttactcttccaacagcaggccacccacaaccccaggggtgccctgtccctcaacacctggcccatgcccctgcccctctctccaagcagggctgcgtgattttgtgatagagaagtagagccagccagtttctgagccagagacaaaggcctttggacaggtccttcctggcagggggagaagagctatttgaggaatatcctttggagagatcctttgcttgttcctcaccagcatggagggaagtagctgcatccaccggactgcgctgggggtggagggcagggccaggctctggtccttggacccaagacgaagggaaatggcctggtgagaagtcctccccccaactaggccctgctgcccctgggaccctcacaccatccgatgaagaggaagaggcacttgcgcaggcgctcagtggagtaggtcatgacaatggccgtgtgcaggtagcagccttccacaaacatccagaagaagttggtcaccacgaagtagttgaagatggtggtgatgcagcggcaccagacctgtgtgcagggcagagaggctgtcaggaggcagcttggggcccaggtaggacatacccatccccaggcagggcaacaagacacagggctccccaaagggggttcgtggacatgccatcaaataccagcgaacctcactctgaaaagcttcatccttctccagtgctctttcacactttcagattaagttaaggtgccattctccactggggccaacgtgttttttttaacttctctctaactctttctaatttttcattctagtaaagagagcaagagtctggctctgagctttctgtaggcagaggctggaattcaaccatcttgttgtgttttcattttagtttttttgagtcattttcaatccatagcaagtcagacctgcttccttttggggatgggatatggaatttcatttagaaaaaaatgaaaaaataaaagtgagtaaagtgagtcaagggtgtatgaagtggggctgcggccagggaggggattctccaaagactctgggtttgggaacttctggacttggcacaattattactagctctggagggagacttgcaaagtacacggcccccggcaagtcactgcacctctctgaacctcaaaaagtaaccctgccttccagggtggttgaaggagatagaggatggcaaagacaggcatgagggtagctgtgttgtggctgtggttgtgcctgctgtggttccgtgccttcccagcagaggggaatgtgtccctgtccctctgagcaaggccacccttccccaggcaccaaggctaccttcccaaaggaggcagggaggggaagaccctgcccctttagagccacgcagtgggccatggcagggccagggtctagacattgggcttccaggccagagctcctctcaacagaccccacctggtcatcttccccacaggctcatccccagggcaccctgagagccaaggctgggacatggggaatgatggagccagctcaaggtccggggagctgtgcgtcaggggctctgcttctgcacacagcccatcctctctgtctggctctgacagccccagttctcagataaccctcctgtgctgagctgttggctgcttctgggcttccctgcacagtccctgtggctggctgtctccttttttctgagaaagtcctgctgaggtgggaagctaccaagcccctcctcccaaccctacttttcatccagggttgatgatgttctattagcacaagcccacgttggagctagaaggcaccctcaactcgagtgaacctgtttgattctgaggcagtgttctatgtgggaccatgttaaggatcacaccaggctggtgtctgctcaggcacaggccacccaaaggaaatgtactgagaagtctctgtcggtgtgccacagggctctgtgatggcccaagactagtctacagttttacaatagcttggacacagtacacagcaatggacagaaatccagagtggacagttagcatgtgggatagccccttatgtagaggtatcatcactgcatgtgaccttggcgagtcacttaacctctgtgagtctcagtttccatgtctatgtaatggggaaaatgatccctgctggtctcattaggattaagtgagagaaagctcaacagaggttagttctagcttccttttctcaaaggggtctttgagggcacctgaatccacaagatgaggagtggactaggataaatgtgtctagagtcagctttgtgaagctcccagcctggcagcttcctgctcctcccagcccagctctgttgggacaatggctagggtggaggtgagctcaggtctggttttgcacctgagccacagcccagatgacagcattctggccatgggtcagccaaggagcagccagaaagtcagttgtcaccagctgagagtagcagggactggtgaacatcagtctctgtgtgcaaatctccaaggggtctgtctcagagcctggagagagcagaggggatctgttctcagagtgggggcaagaatggggtggagttgcagaagttcaacattaggaagagcttgtaagagtaaaagctgctcaagaagaagagggctgctttagcaggtagtgagcttcctgacaaaggaggggtccaagcagagaccagacagacagatgggtgcccccggagcccagagccccccaggtatagccccgagtctccccgagcaatgacctcattgctctcgtgcacttcatggtcaacgagctgcagcaggaaccacatgacatttcgcaggataaaggtggtgatgaggttccagtgaatcacattccgcagacagcgaatgctcctgtgggaggtgcaggtcaggggtcagccaggttcaggggtcaactgggactgggttccccctgaggccaggtagagactcagcctgggatgagggcagggctgcactaggagccacttcccacccatggtggccacagttgggcctctgagtccagctcccactctgcaccccacatgcctgctggtgattcatgccctggcaccccacccaaaccccactttctccacgggcccttttatctgctgggccccagaatggaggtgagaatgtctgggagaggtgaagggggtgctgtagggggagggatgaggagaaagcaaggcggaagggcagactcaccgcagggccaggaaaagcaggaaggcggccaccagggctgccacagatacgcagtggcccaggtagttgacgacaagggcgatgcggtagtgcaggtcatacttcctctgctggacagacagacatgggcagggcagatggaggcatgggcacgtgggggtggggctgggtattccagccgtggccacctctgtgtcctgaccttgggggcagaagtgctccaggtgtcattgccgtgcctggctcttagggttcgttcctgttggccctgggtggctcttgttgttataaatggctgtggtcaggccttccaacatgcatttatttttatttttttagagatggggtatcactctgttgcccaagctggggtccagtggctattcacaggtgtgatcacagtgcaccgcagccttgatctgcaggcctgaagcaatcctcccacctcagcctctgaagtagctgggactacagacaagtgccactgtgcctggcaccaacatgcatttttgggggcacattttgagaggtatgggtacagattcttttttaaaattctaggctctagaatgcttctcctgagtttagtctcagcccggatcccagctggctgagtgactgagggtgagtcgatttttatttctggacctcagttttgatgtctatacaatggggccaacctgccatcctacctaagaagcaatggcctatgggaggcctggggtggggtgcattgagattagtctgccctggagaccacacgagggggtgcactgtctatagagaatttagaaattctattcaaactgaataaaagtcagttgacttttaattatcaccaagtgttggcaatttgaaacaaagttagtgatgaaatactccttcctgccagggagagccacccctccaccctacccaacccctgtgttgattctccactgctggaggggcagagagagtggaggtgaggaccaagggctggaggcccccctgcccattgagtggcctccctgcagaacccctgtggctcacattttgcagaatcactttctcagggcgggtgaatgtttttccctctcaatttggacttcatctggggcaaagtcccagccccactgaggactatgctgggtaatgaggaggggatggagctgagatgtatcctttcaggtcaggaatgaggcgtagcctcaaggagaggagttcggtgcctcagcagcactgaattgaattccagagcgagagctggagcagggctccagagaggcagagcaggacccagcttctcatggggacagcccttggggggctgcatttgtttccatgtggagtcacagaatcagaatgccagatggggaaactgaggcccagagggagaggaaggtgtgcagtcacacaacccctaagatgttaggagcattgattacacggttattccctttttgtgtcacatgccaccttggctttgtcctctagcagcccaagctctcttgaaggtaggactccatgtcccccttctctactcccctacagtgtcactaagcacagggcaggacactgggggcaggggcaggaggtacagaagggagtgactgggtgacaaaaggactggtctgccccccttgggatcttctctgctcaacctgagtccaaatacctgtgtgaggcctggggtcacagcaggtgagggccactcaccttgtcatccaaaatgggctcacactgtgagtagttgatctttgaggcccacgtcccattctccaagcattctcgataggcattccctacaaaaaatgccaactgccaagagtcaggtcactcccctcctcaagaaccctccctggctccctggtgcccacaggataaggtgtacgcacctcagctctcctagggcagcaaatacaatgtgcatctgaaagtttacatgtaagtcacttatgtgaaaatagcacaaaaggctcatcttacaaaatagctaaaggcatgctaaaacccattttagacacaatctttgactagcattttgtacactttcattttgttcatttgcttcaaaactgaatccaactgtgaggagtgggttgtgcctgaagattcactgctttcagcatgccacataatttacatccttgtctcaattgttttatatttatgaggtccatacttcaccaatatcagcacttccatttttataatagctaccatttatatagcatatgtttcccatgtaccacttcctcttctaactgctatggatatacatgtcaattcaatctccacaaccatcccatgaaggaggcattaatatgaacccatttcaaagaggaggaaactgaggcataaagagattaagctactggccaaggatacaaagatgacaagaggattcaaactcagaagttgtggcttcgggtcttctgttcttaacctttaggccatatcaagtagtggcaaacaggaatgagtgaatgctggggactcagggctgggccaccgccctcgggctgctgctgcctgggaggctaccacgagatgtttctaaatgttcaagaaccagcctctgtatttaagttggaacatgatttaagtgtgaaaagacatttcaagcagcaatgtcctgtgcacaaaagtgcaggttttgtcaagggggaaggtaggaaagttaaaaaatgctcacatttgcctttctctctatctcagctccaactgtcaaggtctggctcctaagccaccccctccatacaccagctccaatcaggaggaagccctcccacctgagaaggcccggagctctcgaagcctgcctctgcttggccttcatcactagtgtgtttctgacctaccgggtgggttacaaatgctgaacgttccattgtttgggggtgatttgtaccagggttcagctctctgactaatgggcagttgtctgtgaatttttctttctagcatatgttagatgtacaatgtaaagctaattaaaataaatagcttgcagagcacagagttgcagagctggagggggaaccttaggttgtttttggaagcagtgtgttctgaaataattaagttacttaaaaacccacttccgttgagcccgatgagttggaagcaatggaattgggaaggagcacttgccgaagagcaaaatcaatggggaagattctattagcttaattgttttttagtttggtgcctggagctcatccattcttcaaacccagggacgtgactggcctattccttcctcctgggccaaggcccatccctggcagggccctgccatccccctgccaagtgagtcagggaatgccctggtctgatgctgattctgactctcaggaagaggaagcctgctccccacccctagccatggcgcccaactccccaggtgggatctaatttgatacctagcactatctttccttaccaacattcgtgctcatgaaagagaaaggttacctcaactcgtgagggtcagtgatagtgatgtcactgaactaaaaaagcaaaagtatgtaaggagggtaagttcttttgtgaaatgaacagtccctccctgatgggggtttacggtgcctctgaacagtctatgtgaggtgaggcagaccaggatcctgcctgtgcttcaaagggcagaaaaatttatcttctatatgttcatagatattatccagctttcctgaagctcagtgctaggccccttccttcaggaagacctccttgattgcttctactctatagctctctctctcctgagcacctccagtcctgaccgcctgagccccacactccagcccttgccccatgaccagcctggagctgtctaggtgagtgagtctggtcactctgatcaatgtgggggctccctgaggacagggccttggaatacttgtttcccgaatatgatatctcatggtggcactgatcatggggtgggcttgcaggtgggagggggtcaggatagaaatgctgcaaatcagagacctttcctctccctcacaccaatgcccatggggtcccaagttccatggattctgtctcctccttttctttttccagagtcaactcccctcctgcccatccctccatctgctctctagtcttcttgcctgggctgctacaacagcctcctctcctcttgcctccctgcttcttttcttgccaccttgaccatgttgatttctgcttaaagccatcagtggctctttattgtgctcaagaataaagtccaatttcttagcatgatagtcaaggcccttgacacccaggtcccagcctaactgtcctgacccatctccagcattctacatggccactggcattggcacacataggtttggcacataccctctttgtgtggatccaccacttaaagcacctcctccttcttacccactgctcacggatgaactcctacccatctttaaccccacactcaaatgccgcctcctgcatggagccatccccgacacccttaggtctgaagcagtcctttctttgtttcctcctctatcccttcccttctcttgtaacgtagtttttccactttattgcccttgaaccacaataacacatacattttatgttataatccagtacacacacacacacacaaacacagaatccagctgtactattttcctttccagcctattctaatgtcttctattcatttcacacacactgatcatgacccactaaattgactccacagtccactcttgtgtcacaatccatagtttgaaaaatacaaattctgttttagtgcatttgccataattcactatgaacttcatctctttggacctaatccttcttttctttgctactggacttgagctccttggggatagacaagtaagtagaagccatattggagccaccatatctccctcaggacagagccattgaggaaatgtcggctgaacagaattgactcagacctgctgacccctgggaaagcaggtgggatgcagaagcgggaggggacttccctctctggcagcccagccctgcctgcagatgagcttctggttacagacactgggtatcaaaggactggaggatagatgtgccccactcttcaggggagctgtctgctgtggccaatgagggcactgggccctcaggcacagcctcggacaggagggagtaagacagaaagaatctcatccaccccgtgggaaacgtagacggatgggcacacactctgagggctgatggcaaggctagaattgtggggctggatgcagagaggtgggtgcccattaccatagcaacacaggtgcccctgctgaggatcagtgctgatgatgtggagtgtgggcttccaggggcattagggtctgaatgatgcaggcagggtcttctcttgcaggactctgtagtctgggaggcctggtttccatgcccagagtggcccaggcctgccaaaaacccccattacaatgggctctccccgtttcagatgctgacactttgcaaagagttcctggttcaggcagttacctggggtggtcctgaagcctggctgggacatgagaccctatattctagctgtagttttgtctctagatagctaggtgaccatgactaagccccttccctcttggtctcagttttgcctcttagaaatattacagtaaattgattctctatgatgttattggcatctcaggtggatcaattatatgttatgtgagactccccagtctactaaatgccagttagcaccctcaagctattgtgacaactccaagcatcctgacatcaccatcaaatggttggcacttctatctctgataccttctggaaagacatggaccataggagacagggaccatgagggactacttttggtggtagttttgggggaaggagtacaagggacaggggtaggcatggggaaaagagttaatgggactgtggtaaggcacaacaatggggtcattggctatttgcaaagaaaaggacaggaagtgagggagaggctggatatggtggctcatgcctgtaatcccaacattttgggagaccaaggcaggtgaattgcttgagcccaagagtttgaaactagcctgagcaacatgatgaaaccccatctctcaaaaaaaaaaaaaaaaaaaaaaatagccaggcgtggtggtgtgcgcctgtagtctcagctactcagaaggctgaagtgagagaattgcttgagcctgggaggcagaggttgtggtgagctgagattgtgccactgcactccagcctgggtgacagagtgagaccctgtgatgatgatgatgatgatgatgatgatgatgatgatgataatgatgatgatgatagaagaagaaggaggatgaagaggaggaggaggaggagaagaagaagaggtagtactagtagtagtagtggtggtgagggagagaaggtgatgacattgaggtggggagggccagaagcaatatttacagaaggaatgaagtcactacatgggatcggaactttcagcaccgcggacagcacaactccattcttcatccctgcctatctctaaggttggggacctcggagagctcctaagaaccagccttcccacccgatattccgaccttggccatgggcccagcccattgaggtcaagctaattcatgccccttttcaaggcccagctccagccccagctcctccaggtagtttccatgactgttccagctccccaagggtccagctgcttgtgactgcctggctcatgctaggctgggattgatctttcactgacccctataaaggtgttgtactttcctaaccagcccaggttctctggagcagaagtttaccttattttgtacaaggctgagagcctctaaaggcatgtcctgggttgctgtcatctctggccttttcttaagcactgcacagagctgagcacacaggatctcaggatggaccaaagctgatgctgtttcctaggttacttgggaactcattgaaggtaggaggctcagagtgggccaggaggacagtctgccaccttgtatgcccatgcttcaccaagatgcatggcaaatacaaaacagtcacacatacatgcaggaggaagcaaggtctcacacaaagacaccatgggtaggctgacccagctgccaaaactgcagacattgcagtccaaccccacatgggggaggggtgtcagtctcaaacagcaaacctgtgggcagcattctccaggttcctggcatgaaagctttgactgttccaagggaagcaagttggaaactgagttatcaggcatctccttgggaattaggaaggaagacaacttctgcatttggtctggtgggaccagaagagagaaactgacacatctggggtcactcaaccatgaagaggcagaagatctctctcccttgggacacgcttcctcacgggagaccctggagttggtgtacctaggagagacagactctccctgtgaccctgtgtttcagcagatgcagccagttatgccacctcttcagtgtcattaccacttggtgtccagatcctcagaagagaataccttaggggccagatatcccaccctcagttccctttactgcctgtagttgggccactccagatccagccatcttcttgtctggcctggggcctagttgagaaatctttgaccatgactttgagtcacctttcttacctactttttttttttttgagatggggtctcactctgtcacccaggttggggggcagtggtgtgatcttagctcactgcagccttgaactcctatactcaagtgatcctcctgcctcagcctcctgagtaatgggactacaggcatgtgccaccatgccatgatcatttgttatttttttgtttgttttgtagaaacggggtctcactatgtggttttggctggtctcaaactcctggcctcaagtgatcctcctgcctcagcctcccaaaatgttgggattgcaggcatgagccaccatgcctggccatctttcttgctttctgtgggaaaaacctctcaatcaatgtctcctcccagcttggcctccacttcctggagtggattgcttttcatccccagttaagagacttttggggaaggtggacagagctggggtggtcagacgtacagtcctagtactaacagcatggttttcctgagcttcccaaacgaggtgcatctccttgagtcagcatcctgcattgcttggaggccactgcaggttaaggaggactgaccaactttgaggcccacctggcatatttctgtcttgatccgatcacagcaaattggtggtcagaggggaacaggcagctggtgatgttcacccaagctcagacccagactgacgtagaagtgctagattgagtttgggagtctaatattgccaaccccagccactgggtgggaaaggcatccccagggccctttgctggtgctgtctgggattcaggccagggaacttggattccatttcttagtgttatatggacacagctctctgagcctcgactgcctgttctggaccttcagagaccctcaactccctatttccacaggacttttcactcatggtgccctgccatccttaagcaggacctgtaagcacacttacaggagacagtggggaaactgagtcatagaggcactgagcagtttaatggagaccatactgggtctatgaaaaagggaagggggagtggaacccagctcactgtgtaagctctgccctccccagagaggggcagtgggaggaggcccctacctcatgctcccgcctctactgtacagggctccctccttccagccatcctagcaacactcagtgggctcgtcgccatgacgccagcctgtggaggaaagtggggaggggaccaacacaggacccctgtggcagaagctgccttggaactgagaaacatcactagaactcatcaagccctccacccacctggtgcagatgaactgaggtctgaagaggggagaccacctgcccaaagggagaaaagcagtcagtaggatggccgggattagatctggctctcagttcctagttcctatgaagtaatgcagggagaagacagctggctggcaggatgccagcagcatccctccaggggggcaaggggctgcctttctctacaggcttttaggtaccagaccttctcaatctagatagacagaatcctccctcccaggacatccccagaagccacagagttctgggggctctcagagatagcaggagaccaccaccccagaatgaggatagccattcttggtgtgagcaggatttcccctacccaaggacatgatggcccctccttccaggccccaggccaccttcaactcccctccccttgctgacaatgccttagctgtctacagggagccccaagcagcatcatctcccctgtgtgccatggccccacgaggtcagcatgttctctgtccccttcacacagataagaaaactgggacttggacaaggagggcctgccagtccctcagtgagtcatggcaaacccaggacttagatccagccctgctaaatctgagcccaggttcctcccactctcccttgccccagctgctctcctggcaggtgctgtgtgtgaaagggaccgcctgcctgactctgaagcacctggtgagggtgggcagtcagaggggcccaaatgcctgtacctggggcccagccaagaagccctgtggggagctccctgaggatcactgagatggggctcctccttcagcccgtcttcagggctccaggctctgctgtggcactggtggtaaggagtgcacagggaaggatgctgggacctctgacttaaggagcaggtgggaggagaggaaagggccaaggcccaggtccccagccagcccttgattgagatttagatggcacattttgaaaagcagtatccttccagagtattctggtcctgtgccatagggctacggacaagcagccgctgtctctaaagccagcagaatcgaggcccatgccctggtccaacatttgaggcctccatgatctggcttattcttccctccctcctcttccacttccgctcccaccctcccttccatctgacacatcattagctcaatttttcaaggcactgttcaacaacacttcctccatgaagtcttccaaatttactttcccttactcttggaataactcccttccatgtgctctgactgtcttcactgtgctattttacttgggagcctatatcaaaaagttctctttgagagtctgcctgtctgtcactcttcctagaacaggagcccctggaaggcaggctcaggtcttatgcatctttgaaaagcttgtctctaggctcctcaattctttctgggggaaagggtaaaatactcagaaccccaataaggggtgagcctgagcaagacgatcaggtggctggaggattcctggggagagcaggagacaggaaagatcaagatgcatgcagaggtgggtagaagctagagcagaagccaggagttcccagagccagcagaggcctatcagggcccagacttgctgtagaactctgagcagctgtgtttccctctcctggccagtcatttcctacccttaagtggggaggggaaggctggactcggaacatagagcgctctgcagccgggcagctctggggtgtctggatggccacaagggcatccacttctgctctatttctcttccttccttcttttcttagctaaacctctgtgatggccatgcctgtcccaccttccctctctcccagcagggaagttgttctcacacatggagtaacttgtggcccttggagaatggaatagagtcaggggggatcaggtctcgctggagtctgagaatgcagacctgagtttccggatttacagcttctacttcttcaacccagagggcagggtctatctggggtcctcctgaggcttgcacccctgcactgcgcctgtccttaacaaatgtggcatcccaactgctccaagacctttaaagtttacccccactccctccagaaagcctcccaggaatgtcccagtgtccaccaagcccctcttcccgatctctgactgttgatttgcacaagcctccttgataagcagcctggggcttcctgagggcaggtctcagcctttcttatcacctctgactcttagggctgaagaagggattcctgcataagcaggcagacccaatgggagagacccctctggctggagaccactcagcttatgtgtttccattgtaacacaatcagtgcttaagcatgtctctagaatggggttctgggaagtggggacccctaacctccccatgtggctaggttagatgggatgccccttcttcccctgtcctggcagatgcctcagtacagatgaccccagccattcccagtaggacattgcggagcttgaggtcaaggaggctgaggctcagccaagctgcacttagtggttccacagaaggaaaatggaccatggccaggagggaggtggcaagaccctcctttgcagccaaaaggaccgtagggacaggcaagatgaggtgcaggaggagggcagatagaaggagggatgggagtggggagacagtgggtttggagatggagtcgggggatgaagaaggcagtagggagagatggagaaagagagagagaggtagaaaatgagagaatctgagaaagacagaaacatacacccagaaacagaaccacacatagagaaaatcagaaacagacagggagacaatgagagagacacagagacagagatgtacacacagagatgggctcagaggagtccgtgtggaatggggagaggtgggaggaaaatggaatataagtgccccacttctggccaaaccacttccatgctaatccacttcctttcggcctacagacagggagacaggcccacaaaagggatgagacttgccccaattaaattgtatatggacatttaggattgtttctagccacccaggatttgaacctgggttcggagaatcctggggtaagaccgaggctacctccccgcctagagctaaaatgccagatccttacttcccaggatcccttgtagccagagctttggcatgggatttggggctccacatattcccccacccatcagatgcacctacccgagggaattagtgaactggaggcccccagatggagacagggagaaagcctctccagagataactgcaggaagcttaagactccaggttggccaggtgcagtggctcacgcctatactcccagcactttgggagccagagacaggaggatcgcttgagtctgggagttcaagaccagctctggcaaaatggcaagatcccaactctacaaaaaatttaaaaattagccaggtgtggtggcatgtgcctgcagtctcagctactcgggaggctgaggcaggaggattgcttgggcacaggagtttgagattgcagtgatctttgatcatgccactagtggtggccagggctggtggtgttggcagggcctttcagggagagggaggtcccctcacagggccagctctgccctgtgttcttggcttggggccccaaatctggttctctagcccactcagtgattccataagctccccaatatctttttaaaaaatttcttctctgcttaacctagcagagttgctttttgaaaggcagcagaacctgggtttgaatccttgttctgttacaagtgacttcattgctccacacctcagtttccccatgtgtaaaatgaggataatgccatgtctctgtcactcgatggtgcaaggattaaatgagttaaaccacagtacaaacatgtggaagctcagccactgaagcgccagcacaggttgtgtagagaacacccaaggagactcgtgtgcttaacttggctctgccactgactaacatgtgtggccatgcgctagtcccttcccttcccttggccctgctgcatctggaaataactctgggtaagatggctcaaggctctgacccagcctcccaaactcacacactgtagctatttgctaaccccacatcctgaggacttctaaacgccttatctccactcttggtgctctcttgagcttttcccccacccaaccagctgcttcctgaacatctccactcagctgtccctccagctcctcaaagtcaacacatccccaactgtgctcagctgtttcctgtgtgcccaacctttaccttgccatctctcaccatatcttgtcaatttcaaatgcccaaggttgctggcgtcttcaacctcatttgctcttacagcctgcggtctacctgggtctgtgcagaaatccccttacttctcctttccctccagaggacagtgtgctcccaaaattgagcttctctgctcacaagctcacccaggctccctctccagatggtgaagccctgtagaatgccctgcatcacctgacctccatgcccctccccagcctcattgtttctttctcctactccctgttctccatacaacacactcctcccaaggcacaaagcccagcctgtctccttgcctttgctcagtcccctcagcctagagggcctctcctgtgcctattacactcacctgctaaaatccaacctgtccccagaagtccagctcagagggctaagtcctccctgatcctccaggccggaggtatgagtcttctttccaaacctctaagctctcctcgcaaaccgaatgcctcttgtggagggagtactgccccatggttaatagcgagggctgtggattcacctgcctgcactggtgcataggagctgattaggactttcaataagttacttcatgtgtctgagactcagtgttcttgcctgcaatatgggcataaaagcagtatgtatctcagagggagtgtgggcgagtgggattatggatgcctgagatatggatacaaagctctctcagtggtagctggcacctggaaaatgatcaacacttagctttgtggcagattctctgtgctcagctgagttgaaaaatcgcagagactaatatctaaactgctatccccacccgggcgattcctgctctctaaggaatgaggcttcaatgcgggtttggctatagcataacaaaattggggcaggaagtggagcctgaacgctcctgttcttcccctaggcttctcgtggaggtttctccctctgtcattctttttaaaggaaggatcccaaggaaaaggcaaacagagaagcaggaagcagcactgatgtgaagaaaggggaggagggaaatcaatcatgcatttccacagccattagcagcctctgctcttcccacctaggctgacctcacaccccaggtgctggttagtggtaagtgctccccaccctccacaagctcctctcattctccagcagttgcagtgcaggcagcactttggtctaaatgaagaaaattgttcattagataccaggggctaattggccctacttttaccagcctgggtggtgccccaaccttttatcagcttctcattagacttaattgatatgaatggcctgatatgtgctgtctgcagcacctttgggaagtcttccttgtcaccccgcccccacaccccaatcccatagaccttgtgcttcccccctaattagggcattcatcattctgttctttttgtctgttgcaattgtgagtgagagcctcaatacagtgcctgtgcagtggctggcacatagtgggtattccacaaattgactgagtattactgtactcagcttggctatgaagaagagacccaggccctgggaagggggggcccccaggctggtcggggagaacaaggcatagcccaggctggggtaagaacgaaagcagagctccctgaggttcacaggctgtgggctgagatgctccatcaccccactttaccctggatggcccttaatctccgggcccagtctgaatcaggcatgctgatctccattgccccaccccacacagctcacggaatcctaaaaatacagttttataaggtcaggactaggaaggcacagggaaatcattccttctgcttgcacacctcctagcttggggatcttacttccttctagggagatctgttttaatcatggatgggaagcatgtgctccctgggcccaccagagccctcagctggtgcagccaggagagtgcggcttggcatcaggtgcaggtacatctctcttgccttctaaccatctctcatggcaaagccctcagcctcagcttctgaaagcttgtgtgtgtgtgtgtgtgtgtgtgtgtgtgtgtgtgtatgtgtggtggaggtggagctgggctaccaatcagacacagacactctgaggatgtttccaggatgagaggcttcagacaaacaatccagatagggtctcagcgtgcttgacaactggggtccggctggagatatcaggggggttctaggtggggcagtgattgctgcccccacagcctcccgcagaccacacacctggctcccatcccatgttccacagggcacagacaggcacctacccacacgcacacacccagaacccacactgaacgaccccacctggaggctgtgtaactccagcaacctctactgcccttttccccagagcctcaagccagtccatgatttgccaggaggaaggcaggcacaggttgttctccttgagagatggtgttggggtgctgattcagacaccactcattatgggggcgcaggaataatgctgcccacagcccctgactcagcccagcaggtcagtcctgggacctcggattagggaagatgcaacaccccgcaccctctggcttagcagaacctacgcctgcatgtcctccccacgaaacatgcgctcgccccagccctcctgcctcctaccctcctcctcccctctggtagtagggtctggtcactgcactcactctgggggatttgggacttagcatatccgccctcctgggataggtccccctcctgggcaggggaagcattgtctaaacaatgaagccctaatggggaacttcaggcaacgggaacctacaatgagggaaggaggtttacactccaagaggaggaagtatttccttctcccctttttgggctgtcaccgcatggagcacgggaattgtgggcaaatcactggcttactgagattagacgctgtattgggggtagaagcagaaggcgcgcccccaacactgtaaggggtccttaacgcccgcggtccgcggtaccgcggccgtcagcagctttgtaccgctgggtccggaatcctctttactccctaaaccgccttctcaggaggccggtgtagagcaggcagcgagggccgggggcactcacgggtcgtgttgtacttgacgccgttgaagtactcggggcacggcctctccacgagggctccggcagcgctgcggggccagcacgttccgatctggtccaaggtcgtgttgcagtaggagtagggacctggcggcgggagagagcgcagtagggctcagaggggcccgcagggacgcggggctctcggagcgcggggtcaggggcgcacccagcgcgcgagagaaggagcccgcgcagcctccgaccgctcgcctcccgcctaccctcggggtccaggggtggcccccagccgtccaagagcagctcttcagccagcgccaggctgcagttggcctccagcaggctgtggagcagtgccgcgtccatcgcgtcccgcagccgcgtgcggagagggagtgggagtgcgcgcccggcgtgactgcgagggagtggacgcgagagtgagcggccgagagggcgcggggtcctggcccccgccagcccagccccgatctcccgggcagcctttgggcgccacctccggtcgcccagagctgtcaagtggggaccttcccggagaggagccgccgagtgcacggagctgcgggtacagccgctccgccgcggccaatggctgcgccggggggcggggccgggcggctcctctcggaggggctcagtctccagcccccgggccctccaccctgcccaaagtacggcttctcagttcgcagctctcttccactcgcggcgtccagaggagggcggtgggctggagagcgtgggcctggggtgacggaatgctctgtgcggggatcgcaggcccccgagctgcagggggcagcaaagcgcgcccacctgcccgcctgcccgaggagaacaccgcagctctgctaatcgagggacagccgcaacccaaagttcggcagctttccgcctgagcttcccctccctgagcgaggacactggagggaggcagagacggagagcccatgggcagatctgcatcctccaaaagcctccatagcctctgggaaggaaatgtatcgaggaggcctggagggaagcagggagacacccatgagtctaatgagatcaagtggcctgagtgggttgaagtccttggatcagaccgtggaagctggaatggagagagatttcggaggggcagccagacctggtgaggaggaactggagtgggtggctggttttaagtaggagcccagaggcagggataacatcaggtctcctgcttgagtgactgggtggccatttaatcagatggagtaagtctaggggagaaattggctgaaattatctggaaggctttatacacccagttgttagtgccttgggcaccagaaagaataaaggaagaagtgagaatgtgtctctcttcctcaaggcttgggcagggcttcacctgaccctggtttccacaccagtagcggggcaggggcggggagaatcaggccccacagcaggtgtggaggagctggaaacctccccagagaacttgcccaggccccccaccccaccctggcccagaatgcctccttggtgatctgctgtggctgcaccctcagagtgcccagggcgggcctgctgtgtctgccagctgagtggggcattgggctcgggaagcagggcctggggtaaggcatgcttccactcaggctgcattttggtccagcctctgactctgctctccctgccatggtaccccaggcaggatgcttgccctctcttctggagctttctccatcagtgaaatcttccccgaggcccctctcagctctgagactctctggttctgagttatgagacggagagtctggggaagacatacatgtgtgttgtgtgttgtttgtttctatctttagagggcaaggagagctggaacctagtctcagaaaccagtcctgttcccctgccatcctccacataaacctaagctgctaggaaaggctgaaaccaccatgaactagcaccatgccctgggcagagagaggcaaagcagcaggcaggctgcttttgtgtgctccgctctcaccagcctccatattaatggtgctgtcactgcccaggcagagcgagtgagaccacactaagaccagggctgagccctggaatctctccagggcctgctgactggcaggaacaagatgctgagcagccagccaggtctaccctctgcctcctgaatggacagtgagagcccaggctcagctctgggcagctgcagaggtagaggttccttggtcttcatattatccagtgccaggagcaggggaggacctaggcagagtcctaccctccgctcctagactgagccctgttacccagggtcccacacaggccagagggtggctggccaggtcagcccatgtattcacagggcaatagtgtccctcatatacaagggatagcccttcacacagcacggtgcagcacagaggaagggagaaatcctaagccaagcttaagttattatccttgttcattactgcagccaccacctaggtggtgcctaaagcacctatagatgcagctatgtcaagaggtggtgtgctcccaatgaccagaggccagggacttctcatctcatgcagatttctgcagaacagagggttggcctgggtgaactggattgctcttaactgggagagctcacataccaaagattcttctgggaagtgaccatttcagtggcagagtcaaaggctgttctgcatcctgaatgagcagttggggtctgagcacatacccacagacccacagacccgaggtcccctggatgtggggccatttcttcatggatcttattattataggcacagttgtcattcgagatgtgacagagggaaaactagaaaaggtagcagtttgggaacaaattgattttacagctcactttagtgtctgcaaacaggcaaatgaggaagaaattgggaagagccccaaaattccctcaattttactaaatccaagtacaaacaaacaaagacaggggcatttttgctaactaaagaagcagaggtagattagaggctttgggatagtgatgggttcccagcgctgcaggccagccccatcccagctggaggccaggaattaggggataagtatttggaacagtttgtgtgtccccaagctgttggggacaggttggcaaataggttcagggaagtgtgacaggtactttggaagacccctgtgtaccatgagcagcagagtaaggcaggtgcctctggtgccctgcatcccatcccatggcccacctctgatgtcagctgcagcagcagtggacagttccaggccagctcagacacacttgcaaagcctaatacatggcatcaaacaggcatgtaggcacaacagaatcacacacagagccacagttatgcatcttcaccatgcacacacattctctctctaattcatcccctaccactcaaatgtcagctggaaaacaggatttaaagggacaggatgcatctttgcttctctaagggactgtccttggttagactacatagagagggagtctattcaggcacagctggaatagtcgtggtgtttcctgggaattacgacggggttgctgagggcacagaggttccagaggggcctgaaggtgctgcacttttgccctgtagcactggagacaggggtcccaggccaggcaccccctcctcaccctatcctactccactgcaggacagaggaattggcctggtgtcttcatgtcaaaccatgggactaagctgtggggacagaaaggactctcagtgacatccaatcccacattcttgttttacagatggacaataggattcccagacaagcaaaagaggtttccctcccttacttctcccaggccatcctcatctctgcagcagcccaaatgggctccctgtctcctcatggcagataaaacgatgttttataattacgatcctgtcactcttcctcataggagtgccgccaacccattgcccttgagatggagaccacctctttggtattgcaaagaaggtccttcgtaatcatctatccctcatcctcacccttctgctccatttgaaaggccctccagaacaacatgtcattcctgggaaccatctttggtattgcaaagaaggttcttcatgatcatcgtcccccatcctcaccctcctgcttcatttgaaaggccctccagaacaatgtgtcactaccagaaaccattcgctatctctgttccttgtttgtatttctgcactggaaatggccttacagctccacactcatccttcagacatgcagctccttggtgaccccatctgctgggtgctggcctatgtcacatccaggttgctttttattcattgtctcatctaccagcccatgcctccccaagggcagggctggtcctggttcactaacccatccccagcacccattggaatgctctagacttcagcccagtgagtcactaagaaaggacagataccttggcagaagagctgaggaaagcccaggtccctgtcttcaggccaaggctctcttcccatttgaccaaccctggcatatgtgtgtgtgttgcattgaggaattatttcaaggtatctttgaatccattcggattcttggccaggtgcagtggctcacacccataatctcagcacttggggaagccaaggtaggcagattgcttgagcacaggaattcaagaccagcctacaaaaaataataaaaaataaataaatagtccatttggatttttatatcatctatggataggataaataatatgcctcataatatatgccctaatatttttcaaatatatgtagctgcctctgtgatgaataaaatagaaataatctatttaaaccctgcctgaagtcataattgctctgtgattttgcatgcgttgcctttttcaggggcatacaattgaattgatcatagattcgtgaccctttgtcattattagtctgtgcattagcccatgcatggcttaactttattttttagtctttattttatttagtctttttattgtatgtagtagacaatataataagcctaccacccaattggaaactacatcattaccagtcacttatctatttatttctattctccttccccagagggaacattcccttgactattgcatttgtcattctctggctcatattttttttcagttttctcacaggtatgtacatctaaaagatatagtgtttggttttacttggttttgaactctgcgttagacatgatgcatttccccaagcagtggacactgaaaagaaggtcattatcaatttggggacttgagaaatgattcctgaagctcgaggggctccctagcagcctctacatccaccatccggtcatggttcatgtggggtgatgcatccccagagtggctgctaggcagcgtcacaagcgatgcggtggttgaatatttaatgacatggggaaatgttcactctgagttataagaggaaaaagcaggcgacgaaactatggacacactattatcccattaaaaaaaaaagaaaagaaaaagaaaataaaaaaacaattgaacatgaggctctatgaatgcataaattcttgagggatatgaggcattataaaaattcctgggttgtgggagaatgagtacttatcatcttctcctttgagttaaatttttttgtgcccaattttatagaaatcatgtggatcccttttgcaaatggatgaatgctgttagaagctgaacaggcaaggctgtatgtttggagaagctgggaccctatccgctgcactcagagcggggaccatccgccaagggagacagggaagggtctgtgccacctgctggagggagggcagaggaaggcagggagaaggctatgggtctgctgacaaacccacgctgcctctgagggtgagggaaggttgggctttcctgaagggaggggcctccatttcctgtctgatgctggcatggcctgtgctaggtgtccccgtgggctctcattcagccttcactgtgagcctccgaggtggacttagatccattgctaaacagatgaggaaactagcttcagatggtgtcacaggctgaactgtgttgctccaaaatttgtatgttgaagtcctaactcccagtacctcagaatgtggccttgtttggatttagggtcttcgatgaggtgattaaagtaaagtaaggtaagcgggctttaatccaataggactggtgttcttagaagaagaagagattgggacacagacatgcagaggagagaccatatgaagacatagggagaaagatggccatctgcaagccaagtagggaggcctcaggaggaaccaaccctgcccacagcttgatcttggcctaccagcctccagaatggtgatgaaatcagcttctgctcaagcccccagtctgtggtgctttgttccagtggccccaggacactaatacagatgggttaggtgagtttccaggggctgggcgaggccgctgggtggaagagctaggatccagacttggatctacctgatcccaacaccggagctattgactgccccagtggaaggagaacaggcagcaagactttctctttgacgcctggcttgggcagtgcctgtaggctgggtctgggtgctggccagcacccttgtctccttgtgccctggcagtggccccaggcccgagcaagggtcacccccactcccatcctgtggatgcagacctgggaaggccaggatacagggtgggacactggagacatctctctggaacccagcagaatccagggctctgtgcagctctgcagtggctggccctgaccctgtgaatcagccactggaaacctctgaggggccagaactcagggccgggctgctgctttgcaagtccttaccaggaagtcacacctgtagccacggcaaccagagaatgtttaccaccttctgccagtttccctggagttggaaagctgaggggtcatccccttcttggactcctgaatgccagcccagctgacttccatcgtgggagctgggaatggggagtggcctcccagccaagcccttcattatcagtggcaagcctgagcctagaatggggaagggcctgcgtaagggccctcagcaaggcagaaatcaaaccaggactggaaaccagcaccccacccaccaccctgctgagcctgggctggccccaggaaagcctcttcctcccgcagggcccacccacatctccaggggctgctgcagggtggtggcagagggtacctacctgagaggttggtgagggtcatgatggtgtggcagtactgctccagaagtgcccacaggggctggtctttgggcatctggctctgcccggctgcctaggggacagcaaggatgagggtcaaagatcaggcccaggctagccattgacagtgcctgtctgcccccatcctatcctatcactcatcccttactcctcttagtacagagagggagaacaaggagggagatgcccatggccacatggagcagcagcagtctggcctgggctggaccgaagaaaggcctcagaagtggcccaatgcagtgttgcctcctaggcaggggtctgctctgtccatccctcagcccccaaggctgtctcctcctcaggctgggatgtgtcactgtcatggggcttgtgtccttctgtcagcaaagctgggtggggggtgggttccattagttgttcattcaaccaacaaatatttgcagaacacctactgtgtgtcaggccctggctgggggaactgatgggtgtccttcaggtagtcccaggccaggtagggatcctctagacttagaaagtgcagaaggaagaggaggcaaatgcatgatttaactttgtttccctgtcacacaggtaagcaggcacttgcaacgaagagcattaggttaatacgtgagagaagtgcctaacctggattcaggaagacagggaaggcttattgggagaggtagcattttggggcacccagaaagatgagtagggacaaaagaagggaccatagggccagcttaggcactcactagggaagatatgtgattgttgcaataatggcaattccatccaaaagatagaaaagcacccaggatcccgtctcctaaaaaatcatcagagtgggtgctggatgtgcacggataaagtagatgtgggcatgtgcacccgtgaagggaccatcttctggtgggaaagatggataggatgtacagttttacggcatgtacgatttactgaggagggcaggggtagcatcacagaagaggtcatgctaatgtgggttttgaagggtgagtaggagcttgccaagctgatcaggccaggaagggcattctagttagagagcacagcatgtgcaaaggcagagaggctggaaaatgcatggtgtatgactgaacgagagcaattcactctaaattctaacgcttggccccattcctcccaagaccactccttttcttgctctatggtcagcgtgtgtgtgtgtgagtacatgcacacacgtgtgtgacttttgtgcccctcccaaccctgagattcctgattctgggattccagaagacactgctccatcagtgtgcagccccttctcttcctgctgcctgtcagatgtactcttcctggcagctgggtcaatgtttgccccaggatgtccccaggggccagagcccaaaagccctcaaacatcacgttctccacattgggctcagtccatttcctgtgctgggactggaagctgcatgctcagccctcaccacgtcagcctggagcttctaatgaatgaccccacctgctcagacaggagagtgctgccccctgcacccctcccggaagcctagggtgaggcagacaccacttggaggcactcactgcacctgtgttctgccaaactcccaccccacgaagtgaggtagagagggaaatgcaggggagcaggtgtgtgtgttgtgtgtgtgtctcggcactgtgggggcctcctgagctgtcagccaggagttctggcctcttggcctgcaggacaaacactgggggccatggtcttgctgtccacatatcaagggagctgctgagagttcctcagctccagcttctcgggcatcaggaagaccttgctgaccccgtgagccactgccaggggttggggggctggggaggggagggaacactccagacactgagaccttccaggaagaattctcaggccatacttttggctgggtctggggacagtgagggctctaggtctgacccatcaccctctttatggcgcccatcgcccttgtttgagaagcagctagtaatgccctctgtgggagggttcccagtgaatcccagcctctggaggtcagggtacgggcaacccagaggcatgcagtgtccacggtgcgcccttaggcagatgcagccattccatctcagatgttagtgccttctctcaaagcccctgagctgtgacatttgtagccccatcactgaggtgatctcctgtttgactttaccggggtttctgacacatgctttgaacccatgatggggtcagggcatcctcccccaggactcaggcaatgtgggatggtccttgccttggattctgtggtctcaggctgtggccatcttctggctgagcaagcactttgtggggagtgggcacagggttaccatactctgcaactgatgcttgctctttgggtctgggcaaaatttggtacaggcatatcagaagtaatttttggagtaatcccagatcctggcttcatctcctataacttctctgctggccccaaaagctgacacagccaaagatactcattctcttcaaggggcttgtttgggtggatttgactcagtccgaagtcgtaatctaccatgcaggtgtcaattttgggcagagcccctagtggtggtggtgatgggtgggcagggaggaggaggaaagagaggctgctgtcctcagaaaacacatggtccaggaaagtcagggacagacatatcttggataatcccattccaaggacttgagaagagctgtcagagtgggtagagtgcacacatcccagtgtgcagagttctggggatgctgggcttagctgtgtggccttggcaagccacttaagttctctgagccttgatctcctcatctttaaaatggggataatacaaatcccacaggattttgtgtgcattcaacaaattactgtaggtcaagagcctggcacgtagaatgcgcacgctgaatggtgactcttggcaaggactttaggagggggctagttagagagctcagtgatgggaggtcgagtcccctcatcgggactcccaaggcccagctcaagctcttcctgcccagaaaagcttcctggaaaccctgtgccccccttccccagctctccagtcagtgtgggactccgtttgccctcagcagctttccctcggacaatgggcccctgaaggtgcagcctccatctccctcactgagctcgcccctcagcggtgctcagtgaatgctcattgaggaaaccgaaggccgttcggcgaactggacattggagcggaatctaaaaggatggaaggacttgggccataggaacagcagtaagaagaggagaaagtgacccaggtagaagctgagaaagcaaaccctcagaggcaggcgagcccagggcccacacaggaaactgcaccatctggtatggaggtgccaagagaagaagaggggagacaggcaggaaggggaggcttctttcacgtgaagtcagcacttactctagtgctagacctgcctctaaatgccctacagaagacagcggattgaatcctcacggcagtctctgaggtagctgcaaataaccccatttcacagatgaggctgctgaggcccagggaagcgaagtcacccaccaaaggtcccacttcaggtaaggggcagaggcaagattcaagcccagtcagttggtaggttatggcttggtcaggttcccatgggaagagctgatcctgggtgaggaagtgaagacctgtgggtcacggatgctgagagggccccagccccagactgggtggctgtggggctcaggaggccgctcaggtgagaagcccctctcttgccacagaggaacaggggccttggaggcagacacctgggtcacgggaggcagacccagccagtgggcaggaccttgcacaagagagatgaggaattataaatattaggtcttagcccccagttcctgacacagaatccctaaaacctttggaatttcctgggtgacaggagtgtcgttagttctaatgaggtgactcttggtgggctgccaaatgcagctggttaccagagagaccaagccatggttagaaggttggagctttcagcaccttcctacaccttggggaagggagacgggctggagattgggttaatatgcctctgtaatggagcctccgtgaaacccctcaaaggtgggattgggggcttctggttggtgaccacctggtggtgcggggagggtggcatccagtgagggcacggtgctctgcgccctccccacagcttggcctgtgtgcctctccatctggctgttcagctatatcctttgtgatagactttaaaataaacctgtaaatagaaatgtttccttgagttttgcaaaatgttatagcacactattgaacccaaagagagggtcatgggaactcttgatttatatagcctgtcggttgggagaatgagaagccctgtcttgcgactggcatctgaattgggggcagtcttgtgggactgaggctttacctgtggaggctgatgccaactccaggaagatagcatcagaattgaattgaattggaggacacccagttggggtccccagagaagtggagaattgcttggggcagaaaatccacacttttggtgtcagaggtgtgtaagagtgtagagaagaaatggaatgttttcctgtttccatttttctttcttctgaggggaacgtcttggacacctgtgctgattagctcttggctgttctagggcagagagctctccaccatgcacaccccagcccatgagactgactgtaggctgtgggagcacagggtccacatctgtgtccccagtccccagttcagagcctggcacacagcaggtgctcaataaatgtttgtcaactgactgactgcttggatggattaatgaaaccatggccccctcagccaggtagagctacatccccacccctaatcccgggagaccaggttgtgggcttttcctgcttgttatatttccttctctctgaactttgctctgagcctagcctgtgtgagggcccaggtcctggttcccgcctctcagtgcctggcatgggaggccctcaccttagaagaggcaaaggagaggccctggctggggaaggatgcaggaatgagagccaagactccagctgctcttcttccaccttgggtcctatccaaacagaacctgtgcccggggccccgacaggcctcaaaggtatcgcctccctggaacctgggggtctggcccagtctagtgttccctccagggcctggcgacaaagcttctgtctaaatttagcccatggtataagctggggagatttacaggaccatgtgtcctgggcccaggctgccagggaccggaggggaatggggtgagctccctccctgctttctccctctgcttcccaaggtcagagaaggactcagctgggaggggcagcattccaccccatgtttgctttcattcagtggatttcattgagcctgagctcaggccctgccccttagggagcacagagttagaggaaggagcaagaggagagggaagagaaggagaaggcttggaggagaagactggaaaagaggggaggaggagtgcagaggagtaggaaaagggaagggaagaaaggaggaaggaggagcagggaggagaggggatgatgaggagagaagaaggggtcagaaaagggagagggggagaatggggaggagagaaggaaggaaggggaggaagaggagtatgggggaaggaggtggaggagactgggaagagaaaggggaggaggtgggggaggaaggaaggatacaggaacggggaggagggggaagaggggaggaaggtggacatgaggaaggagggggaggacgaggcagtcaggccctgcacagacatagggggcagaaatgggagctgagactggccgaggggcgggcgaggggtggggtgtcagatgagggaagtgggtcattgttttctggtgtgttcaggcaggctccttggaagaggagactttagatactcagttctaacttgtagggtgttggatgttgagtgagaatccccttggcctcctgggcagctcccagcggctttcttgttcctgagtctgtgctcggccaagttcgtcttcctaggatgccccactcttccttcccagttcccctccagctcccccgggaggctttaggcctctcctcattctgctgttctctcttctctctgaacgcccatgaatccctctcccctcagtcctgcttgtctcacctgtgccgagccctgggccctgaacactgactggagtaggagggggaaggggaggggagggagaggtgacttggcccaacataggggcaggaactggccagcaggaggtcccgtagcaggccacttggcctaaagctatctccttaattatcaacacatctaatgtccagtttgcataaaagtcacatctcttctgatttgttttggagtctgtccgaatgtcctaaaaataacttgacattaaaattaaataacattaaaattaaaattttgttaaaggaaaggaatctggagtcaggctgtgggccggaatcctggtcctgccacataccagctgagcggccctgggcacgtgagctcacctcacttcctcatctgcaaaatggggagaggatggttttaactcagggcgttggtatgaaggtaaaaataggtgaggtgcatcagtgcccatgataggccctgtagggctgctaagtaaaataaaataagcttattgaataatctgtcccccatgggtttgcaatgactaaaaattagaatgttgagaaagacaaacatcgcatgttatcacttacttgtgggatttaaaattcaaaacaatcgcatggagatagagagtggaagaatggttaccggaggctgggaagggtagtaggggatgggctaacaggtaccaaaaaaaaatagaatgaatacgacgtagtatttcatagtacaacagggtgactgtagtcaataatttaattgtacatttaaaaataactaaaagtataattagattgtctgtaacacaaaggataaattcttgaggggatggataccccattttacatgatgtgattttctacacattgcatgcctgtatcaaaatatctcatgtatcccacaaatatatatacctactatgtacccacaaaaattaaaaataaaaattaaggccaggcgcggtggttcacacctgtaatcccagcactttgggaggccgaggtgggtggatcatgaggtcaggagatcgagaccatcctggccaacatggtgaaacccaatctctactaaaagtacaaaaaaaaattagctgggtatgttggcaggcgcctatagtcctggctactcaggaggctgaggcaggagaatcgcttgaacccaggaggcagaggttgcagtgagccgagattgtgccactgcactccagcctgggcaacagagtgagactccatctcaaaaaaataaaataaaataattaaaattaaaatttaaaaagttagaattttggaagaagtgactgtagataaactagctgtagataaaatggtttaaattaaatgaagtagaatatgacagctaagaagataaagagtagtcccataattcttaaagtgctgcaaatttgagatttaggaggaatacagaattaagtagccattgccctcagacagatttaaaaaaaaaatactgaaacaccaacaaaatggcaaaactagagactaaattagctagtgaggctagaaaacgctcagaagggagttgaatttttgggaaaagtcattcaatgcattagctgctggcaaatggccctggagccccggctctgcagaccctcagtgtgtgtatgttaggggacactgtggactcggtctttggtgtgagccggacaggtcagggagggtccagggactgccagggacttctctgtgttctgttctctttgttgagccttcttggggcagatgggcccaccagaagccaggacctggggcaagaggtcacagaggcaccatcctgagaccctggggggtgtctcgctgtccaaagctccaaggagctggacttagtcagcaggggctgagaggctcctgtgatcttcacagagtgggaggcaagtggcattgctgagcctctttaaacttgtttcctgtctgtaaataagtggtcccaccttcccggtgtttgagtaaggcgcctaacaccacttaacagctgctagattaccacctgcctccggaccagcttcccgaaggcctccacggggaatagggagcaccagggtcaaggctgggtgggttcctccaggctctcagtgtgccctgggccagggcatcctcttcactcaaaagcaccagctggaacccttacaattgcagatcagaccaggcacctcccctgctcagagagctccccatgtcctcagatcccaccaggacccatacagctctgcagtctcccacataatgtcttttcagggttggggccctggggccttacccccaacctgctcccctatcccttcccttggactacccatctccaactctgctatgctgcccacctcccaccaggctcccccatcctgtcaagggccctcacacctacacatgcttcttctgagcccatttactggaacttgtaaacacagactcctttctttcctgccacacccgcttctgggctataaacaccacaagaacaggaaccagatgagcgttcagaccctggatcctccccatgggcagtcctccttaaacactggatgaataactgagaagcctccaaggctgggctctcctgggctgccttccctcccgactgcctgctccaggtctcatcgtctcaggacccgggaaaaagtcccattgccatgaaggccccgtgagaggaaggctgggctttggcgtcagaaaggccgaggtttaagtgctctccagctgcttacatgctgagtggctgtgggtaagtaactggtctctatcccactccgggatccgcaggagagctaggcgcagggcctgggatgacctcaagggacgctgagaccacagtgttgccctgagaatcctagggcacctctggagcagccagcagaagcttcctccgtctaaccagcttgggcggctggcagcatggaccccagagggacgggctgaggggcaacccttgccccaacacttggatctcctggaaggcacctatctggaaaacaagtgggagagggcaagagagctcaaagcccaagatgtcttgggggcagaggggtggatggtgagccccctgtacaaccttcacccatcccaattgcagtctgcaaagtcactcaaaggactcagcaggtctgggggccatctgcctatcggacactgaccacagctcagcatactacctgcctcccacctctctcctccacctggccaggcccccaggaaggcagggaccctcatgtcctcatgctgtatctgtggcggctggcacaaaagcatagctggcattcactgcgtgctcacaccacaccaagcatgatgctgcttgctttacttgtattacctcaatgttcctcacaacaagcttgttcagtaagcaccgttgtgatcctcattttactgatgaggaaactgaggatttgagtaacctgtccaaggtcacacattaagcagcaaagcagggatctggattggttttgtaggcaattatctgttgaattactgttgaatgtattatcctccttatacgtatagggacactaagccccagagaatggtccccaaagctggtctgtggcagagtcaggacagcgacaagcctcttagcttccacaggcactactttccagattgtgaggcctaggacaggtcaccctaccactctgagcctcagtttccccatctgtaaaatggggagaaggctggaggtggaccactcccaccagcctctcccctacttcttcagctctcttttgatggtcgctctgtgtcccttctccccaccttccatcggtggcccctgactctggacaaaggcacggggtgtggctggatgaagctctgagtcttgagaaacccttggagaggctggttctcccagagcccactctgtccccatcgctcatctggtactgggggctgcctgattccaggcactgagaggaaggatggagacaaggcagcaggggcaggaggtggctctctgcgggtccctgggggtaagggtcagaactaggggtgggctggggaaagaagtcaaggatcttgcaggagagatggaggggggtcatgggggtggggagagaatggataggagacagggaatcttggaccctgaggtagtcaagttctggatgctaggatgtcaccccagaaccctctgcttatccacaggggtctcccagtctcatcctggccagcctcacagtttcatcttcccttcccctgccccctcacccaggcacgggatctccaattcatcatcagacacaaggatccccgatccagcccagccaccaggccctgagaccccctcacccaggcacgggatctccaattcatcatcagacacaaggatccccgatccagcccagccaccaggccctgagacccccgcccctagtcatgagagctgggagctccgtgctcctggcgccccacctcgtggactcccactccctgcacttacgtattggagcggcggtgggaggaggcagagcaggcagaggaggaggtgtgggacgtagaggaggcctgggggccctgagggacccctcatgccagtagtggctgggggttagggactggagcctgctgcccagcacggtggtcacaccctggccagcccc

SEQ ID NO: 134 - DNA, 48161 bp, Homo sapiens; identical to SEQ ID NO: 133

SEQ ID NO: 135 - DNA, 63010 bp, Homo sapiens
taatccatcagtcaatcagcaagcatttattgagcacttgttgtattctcagagctccacttggctgtggagagatagcccatgatttaagcccaagttcttacttctacagagctaacttgtgcagagctactggctagaagtgcagtcataaaggagcagtggaaggcattggtctgaactatcacattcattctggccatctggacattggacatgatgcttctgattgtcagacactcatgctccagctccaggatctcccgagggacctgcaggacaaatttcaccaccttcagctccttggacgccttcttctgaatgacgctatcaaaatcacagtctagctggtcactggtgattggccctgttaggacagccaaggtgaactcaaggccatgaagcgtgtggctgaagggagtgaagaacaggaaggccaggtggacatcagggccctagtagaccaacaggcccacagtgccctggaagctgaggctcatctatgccaagcagcaacttcgggcactatccttcgggtagtagagcctggggagaaaggaaagttagaagttaccactgtgctttgtaggcagtgttgcacactggataagattagaagacctggaagcctctacaggtcatacatgacttaggagaaagacattcatccattctttcattcattgagaagacctggagctccaccacctcctcctgtggagctcttgtgatctacttttaccacgtaaacgtttatttatccaacactacgcttattaagcatgtatcaggagctgggctaggaggtaactctttggcctacatcgaatgtcatgatacctgccagaattcacaagatctgatctctgtccatctctccaatcacatttcattccgtgcttcccctaccctgatccagcaataacagctttccttctgttcctcgaatagactgatatagtttggaaattcgtcccctccaaatctcatgttgaaatgtgatccccagtgttggaggtggggcccagagggagatgtttggatcatgggagtggatccttcatgaatgggttggtgccttccctgcggtaatgagtgagttcttgctctattagttcacttgagatctggttgttaaaaggaaactggtgctttcctcccttctctctctcttgctctctctcaccatgtaacacgccagccccccttccccttccaccaggattggatgctctctgaagccttcaccagaagtagatacaggcgccatgcttcttgcacagcctacagaaccatgagccaaataaacctctttcctttataaattaccgagcctcagatatgcctttatattagtacagaatgttatagacataggtaagacacagatcaaggtctttcccactccagacactttgcatttacttttcctttgcacagaattctgttccccaagacttcctcatggccaccccttctcagtattcagccccaggtgaaaggtctctccctcaggatgccttcccagacccccagaccctttcctaaaaagctttcactttactcctcagcacaccgcacgttcggtcgtctccatggcacttactctccatggccatcctgttgacttctttgtttacctgtttatgtcatgttgccccccgggaggaggtacattctacaagagcaagagcctcatctgacctgtatgcagccacggctgcaggacctgggcggactggatctagcaggcatccaggaaatgtttgtggaatcaatgaatgaaagaatgaacaccatggtgagcaaagtgatgtggttcctgaccccacactgctgcacaccttattatgaggagagagagtcaacaaataagcataaataagccctgagttctacaggtgagaaggtggggagtggacaggcacagaggaaaatcatgtgtagacacagggaggcaccatctgcaagccaaggagagaggtctcaggagaaaccacccctgttcacaccttgatcttggacttccagcctccagaactgtgagacaataagtgtcggttgtttaagccacctgatctgtggtacttttttctttgagacggaatctccctctgtcagcaggctggagtgcagtggcatgatctgggctcactgcaacctccaccttctgggttcaagcgattctcctgcctcagcctcccaagtaactgggactacaagtgtgcactaccatgcccatctaagttttgtatttttagtagaaatggggcttcaccatgttggccaggttggtctcgaactcctgacctcatgatctgcccacctcggcctcccaaagtgctgggattacaggtgtgaaccaccatgcccggcctctgtggtactttttaatggcagccccagcaaactaatatacaacccctcattagaagacagatgagcagcaaataaccgccctgccccatgccaggcagggcttttggggaaactctctggggaacatagactggtccagaggcccagaatggctttctcttccctctaccttgcgaccctgaggtcattgacccaaactgctcctcagggtgctaattatctcacctagggaccaaccgcacaggagctagggtgggcctttgaaaaggtgactcagataaagctacttccctgctcaaaacttaacagcagcttcccaccatattcagaataatattccaactcttcccctggcttctgtcatctggttgtgtctgtgtctttgtggcaggttgaataatgtctcctaatgatgtccctatcctaatccctagagcctgtgagtatgtgactttttttttttttttttttgagacagggtctcgctctgtcatcgaagctggagtgcagtggtgtgatctgggctcactgcaacctctgctccccagggttcagcaatcctcctacctcagcctcctaaggagctgggaccacaggcatacaccaccatgccttgctatttttttgtacttttagtagagatggtgtcttgccatgttgcccaggctggtctgaactcctgagctcaagagatctgcctgccttagcctcccaaagtgctgggattacaggtgtgagccacggctcctggccagtacatgactttccatggcaaaagggactctgcagatgagattaatctaaggatcctgagatgaggagaggatcctgggtatctgggtgggcccagtggaatcccatggatctttccttataagagcaaggcgggaggtcagagcaaggaggagatgagatgatagaagcaagaggctgaaggaggggccatgagccaaggaatgcgggtggcccctagaagctgaaaaaggcaaggaacagcttctcccctggagcctccgcaggagttggccctgctaacgctttgggttttgctccataacactcgtttcagatttctgacttctagaactgtatgagtccattctcacactgcgataaagacactgcctgagactgggtaacgtataaacaaaagaagtttaactgactcacagttccatgtggctggggaggcctcaggaaacttatcaggttggcgcaaaagtagttgtggtttttgccattacttttagttgcaaaaccgcaattacttttgcaccaacctaatacagtcatggtggaagcagggcaccttcttcacagggtggcaggagagatgagagagagagatcgagagagagagagcaggggaaactgccacttaaaaaccatcagatctcgtgagaactccctcactctcacgagaacagcataagggaagccacccccaagatccaatcacctcccaccaggtccctctcttgacatgtggggattacaattcgagatgagatttgggtggggacacagagccaaaccatatcgatagagtaagttacctgtggagatatctgtggccttttatctgtggcttaggaacaaaaggaaagacagtttcttgcatgactcagcttaattaagctttcagcttaatttttttttttttttttttttttttagaggcaaggtcttgctctgtcgcccagcctggagtggggtggtaccatcatagctcactgcagcctcaaactcctgggctccggcaatcctcccacctcagcctcctgagtagctgagactataggcttgtgctaccacacccagctaatttttaaaattatttgtagagacttggtctcactatgttgcccaggcagatcttgaactcctgggctcaagcgatcctcctgtcttggcttcccaaagtgctgggattacagacatgagccacagtgcccagccacagcttaagtttttccttttggcatagtgaattggggtcctgagatttcattttcctttcacagagatatggtttggctctgtgtccccacccaaatctcatctcaaattgtaattcccatgtgttggggtaggggcctggtgagaggtgattgatgggagcgtacttcccccttgctgttcttgtgatagtgacggagttctcatgaaatccggttgtttgaaagtgtgtagcacttcccgctttgctctctctctctccttctctgccatggtaaagatgtgcttgctcccccttcaccttccaccatgattgtaagtttcctgaggcctcccacccatgcttcctgttaagccttcggaactgtgagtcaattaaacctcttttcttcatcaattacccagtctcaggtagttctttacagcagtgtgaaaacggaccaatatacacggagacaagcgtggaacaaattctccctcacagatcccagaaggaaccagcgctgctgataccatgaattcacacttccagcccccagcaccatgagaccatcaatttctgtgaagccacccagctagtggtattttgttacagcagccctagcaaacgaacacagcctgcttcactcttcagaaaaccattcactcctgaccctgttcatggtctgtcccctgctgagacgcaagctcaagtaggggagacactgcctatcttttttcacccatgcaaccctcctgcctgttgcagagaaagttctccaacagatacttactgaacgagcataggcatcagagcgactatggtctcccacctacccggccacgttcatcaactctctaaggatcttcttcttgttttccctgacattcttcttggctaatgccaagagtagcaccaccacatctagagtgtaggtgtcagcaagcttgaatgtgtcgtatgtgtcactccatgcctcaatatcacctgaagcataaccaaaccaacaaagaaaaggcatcatgagtttggacaattaattctgcagatttttgtctatttacatcagggcttggcaaactacagttgtggaccaaatccagtcggcccactactttggctttataaataaagttttattgacacatgaggttatggatttatctatatttttatgatccatgccccttccggtccttttttcttttttttttttttttttttttgagacagaggctcgctcttgtctcccaggctggagtccaatggcacaatcttgggtgactgtaacctccacctcctagattcaagcgattctcctgcctcagcctcccaagtagctaggattacaggcgtgcatcaccacgcttggctaattttttgtattttttaatagagacggggtttcaccctgttggccaagctggccttaaactcctgatctcaggtgatctgccccggcttggcgtcccaaagtgctgggattacaggcgtgagccaccgcgcctggccccctgcttcctgtcttctttactactctagcctgcctctcctggaaccatggctgatgcagcataggtaaccaataaatgttcgttaaatgaaggaagaaaacagacacaatttatccctaatgggagtctcatcgcaggagacacgattgacaagctaaaaggagcccactgtgggaagtggcacaatcaggccccggaggaccacccatcctggatgctaggccttccaagcagctgctcacctgagactggatgaggaatgtgggatgcccaggtggaaggggttggatattcaggtaggacaagaaggctgcagagagaggcagcaacatgcataaacatgcaagaccgagagaggcagcctggcatcctccaggcccaagggtggacaggatgactcactcaaccatcagatgttggagcgtaacaagatgtccccagggcacagcacagctccattcggcctggcctggtggtgatatggtttggctgtgtccccacccaaatctcatcttgaattgtagttcccataatccccaagtgtcgtgggaggtaattgaagcatggaagtggttaccctcatgctgttctcgtgacagtgagttgagttctcacgagacctgatggtatgtatttatttatttatttgagaaggagtcttgctctgtccccaggctggagtgcaggagcgcgatctcagctcactgcaacctccgcctcccaggttcaagcgattctcctgcctcagcctcctgagtagctgggattacaggcacgcaccaccaagcccagcaatttatttttttttgttgttgtatttttagtagagatggggtttcactgtgttagccaggatggtctcaatctcctgaccttgtgatccgcccgcctcagcctcccaaagtgctgggattacaggcatgagccaccgcgcccggctgatctgatgattttataagcatctggcaattgccctgctggcactcacttctccttcctgccgccttgtgaagaaggtgacttgcttggccttcgctttccaccatgactgtaagtttcctgaggcctctcaatccatgctgaactgtgagtcaattaaaccttcttcctttgtaaattacccagtctcaggtatgtttttattagcagtgtgagcatggactaatacaggtggcttctcacctgctcctcccctgcacctacctccacaggcatctatgttgaacaggggaaaatgcatcaccactggtccagtttctcctttcaggatgtagcagctggcgggggccttggaccacaaatccagctcagcctcttctacttggggaaaggggatcttgtggcggcggcagtagtcagtggtagcccggatggtctgagaaggaggcaataagaaatggttgcaagacctctccagaagacccctccagaagacccctggggcctggagacccaatgggacctcagctaacagcccagacacacaacagagcaagggtcagcttggacagggacaacatcttctgtaagggaaagagtaagcctctgccatcacccgcactccccagcccacctagagacaacattcgcgaggttagagagtaacctttggggctgggggctgcgggactcagagggcaaggaaaatggtgcctagatgaggctttgaatcccagctctgccacagaaagatgttggagacctcatctctacagtatatatatatatatatatatttcaattagccaggcatgggggcgtgcacctgtagccctagctactcaggaagctgagatgggaagatcatttgagcccaggagcccaacgagatatgtggtatgggtgcatctcatcacctctgcaaaggatctctgtaatagccacctcacaggggtatttggaagataaatgagatattctccatcatcactgtgtaacagaaatataatgtcaccgtgaaggtacttttcttttcttatttttgaggcagagtttcactcttgttgcccaggctggagtgcaatggcatgatctcagctcactgcaacctccgcctccctggtccaagcgattctcctgcctcccgagtagctgggattacagacatgctccaccacgcccggctaatttcatatatttagtagagacagggtttctccatgttggtcaggttggtgatcctcaggtgatccgctcgtctcagtctcccaaagtgctgggattacaggcatgagccaccgcgcccggccgtaaaggtacttttcaattgtctacttgctgcacttgaagaaagtaaaaagaagtaggagaaattaattttaaaaataaatattaaataaaggtgacaccatggggaaacttaatgagaagtagtttctcagttgtaacaagtttcatttattctctttcctgtggcctccttccgtgctgtcctgaaccagagcaaaaggacactgcatgtctcattactgtagcactgaggttactaaacttacataaaacacatctcagtctctgtgtcttagaaaggcatctgttaagtcctgcaagctgactgacaaaactaagcaaggagaattaagatcaatgcgggccaggcgtggtggctcatgtctgtaatcccagcactttgggaggccaaggcgggcagatcacctgaggtcaggagtttgagaccaacctggccaacatggtgaaaccccgtctctactaaaaatacaaaaattagccaggcatgttagcaggtgcctgtaatcccagctacttgggaggctgagacaggagaatcgcttgaacccgggaggcagaggttgcagtgagcccagatagcgccattgcactccaacctgggtgacaagagcaagaaagaggctgggcatggtggctcatggctcatgcctataatcccagcactttgggaggctgaggtgggtggatcacgaggtcaggagatcgagaccatcctggctaacacagtgaaaccccatctctactaaaattacaaaaaattagccgggcatggtggcacatgcctgtagtcctagctacttgggaggctgagacaggagaatcgcttgaacatgggaggcagagattgcagtgagcccagatagcaccactgcactccagcctgggcaacaagaacgagactctgtctcaaaaaaaaaaaaaaaaaaaaagataaatgtataaatgtgtttccaggaacagaaaaccaaatactgcatgttctcacttctaagtgggagctgaatgatgagaacacatggacacacagaggagaacaacacacactggggcctagtgttgggtggagagcgggaggaaggagagggtcagcagaaataactaatgggtactaggcttaatactggggcgatgaaataatcggtacaacaaatccccaggacacaagtttacctatggaacaaacctgtacttgaacccctgaacttaaaagttaaaaaaagatcagtgtgtttgtgttttgcacacaaatgcagaagttgcataagcatatgacttcatagttgtgatctcaagaaaaagggcatttctcctttatcttgttcttgcagttaacgtaagaatattttaaatttctaagtttctgaagtgttagaggaagagatggcccagtagagatgtcggagtaatgtcttatccttttaacatgtggttatttttccttatgtactcaaaggtggcttctttattcagaggagtgatattacaactagaaaccactcattagcaaaaggagatgcagtctcaacaagtgtttcttcttcttcttcttcttcttcttcttttttttttttttttttttttttttgacagagtctcgctctgttgcccaggctggagtgcagtggcgggatcttggctcattgcaacctccgcctcccagattcaagcgattctcctgcctcagccccactagcagctgggattacaggcacgtgccaccatgcctggctaatttttgtatttttagtagagacagggtttcgccatgttggccaggctggtctcaaacacctgacctcaggtgatccacctgcctctacctcccaaagtgctgggattacaggtgtgagccaccgcacccggcttcttcttattttatattgagttgaatatttgagtctaacagttttctacatatacttatctttagagacaggatcttgctgtgtcgcccaggctggagtgcagtggtgcaatcatggctcactgcagcctcaagctcctagactcaggttatcccatctcaacctcctaagtagctgggactacaggcgtgagccaccatgcccagctaatcaaaaaaaatttttttggccgggtgtggtggctcacgcctgtaatcccagcactttgggaggctgaggtgggcagatcacctgaggtcgggagttcaagaccagcctgaccaacatggagcaatcccatctctactaaaaatacaaaaattagctgggtgtggtggcgcatgcctgtaatcctagctacttgtgaggctgaggcaggagaatcgcttgaacctggaaggtggaggttgtggcaagccgatatcgtgccattgcactccagcccgggcaacaagagcgaaactccgtctcaaaaaaaaaaaaaatttgtgtggagatggggtcttgctatgttgcccaggctggtctcaaattgctgatctcaagtgatcctcccaccttggcctcccaaagcactgagattacaggagtgagccaccgtacccagccacttttctacacataaaacagaaatatcatgaaggtgcttcatacctgtattacagaggaatttactgtcataagtaccttctaaagatttgacattcagctgggcacagtggctcatgcctataatcccagcactttggaaggctgaggtgggcggatcacctgaggtcaggagttcaagaccagcctggccaaaatggcaaaaccccgtctctactaaaaatacagaaattagccgggcatggtggcgggcgcctgtaatcccagctactcaggaggctgaggcaagagaatcacttgaacccgggaggcgaaggttgcagtgagccaagatcgcaccacagcacaccagcctgggcgacacagaagactccatctcaaaaaaaaaaaaaagatttgacattcaactatagtagctacatgttggttagtttccttataagccccatcatggaaagaattaaagatgaatttgagaaaaatgaaaaaaaacttagacaatcaggttctgttaaattgttacagatatgtcttgcttaaatttctgtttattggccgggcgtggtggctcacgcctgtaatccctgcactttgggaggccgaggcgggcagatcacaaggtcaggagttcaagaccagcctggccaacatggtgaaaccccgtctctactaaaaatacaaaaattagctgggtgtggtggcgcatgcctgtaatctcagctactcgggaggctgaggcaggagaattgcttgaacccaggaggtggaggttgcagtgagccgagattgtgccactgcactccagcctatgtgatagagcgagactctgtctcaaaaaaaaaaaaaaaattctgtttattactttgtaaccacccaatttgtaggaaaaagtttcatctcatgcaatatgtcaaaagtgtgattgcctcgatgtgtaatcaattgtgatggtgaatattaggtgtcgacttgattgaagggtgcctggaaagctggtattgtttccggatgtgtctctgagggtgctgtcagaggagatgaacatttgagtcagtggactaggagaggaagactcacccacagtgtgggcggacaccctccaattggctgccagtgtgactagaacaaagcagacagaagaaggtgggagaagctggcttgctgggtcctctggctttcatctttctcctgtgctggatacttcctgcccttgaacatcacactccaggttttttggcctttggacccttagacttacaccagtggctcgccaggggctctacggcctttggctacagactgaaggctgcactgtgggcttccctactttttttttttttttttttttgagatggaattttgctcttgttcaccaggctggagtgcaatggcacaatcttggttcactgcaacctccgcctcctgggttcaagtgattctcctgcctcagcctcccgagtagctgggattacaggcacctgccaccacgcccagctaatttttttgtatttttagtagagacgggatttcaccaggttgaccaggctggtctcgaactcctgatcttctgatccacccgcctcggcctcccaaaatgctgagattacaggcgtgagccaccaggcctggctgggcttccctacttttgaggctttcggactcggactgagccactattggtttgtttcttcctcagctcgcagacggcctattgtaggactccaccttgtgatcctgaaactccctttcatctagacatagatcctattggttctgtccctctggagagccctgcctagtatgtcaatataccaattacgaataaggtctttgacatgcattttccatactcggtcattaaaatccgaggtgtattttatcttcatagcacacttcaacttgggccaggcacatttcaagtcctcaagtgccacatgtggccggcaaccactgtagtggacagcttaggtctctgaagtcgtctttgattgaagtttaacaaatgctgccggttttcttcctattactcttgctattctcatcatcaccagataagcattgttgttaatccagaacaccagctatggaccaggcatggtgcagagactctgcagatctcctgcgagccagatgatgtgattcccattttcaggatgagaaaactgaggttcagaggttaagcctatcgctcggggtcatgcagcagagatttggcagaaaaggactcccaagaccttgatatctcattccacctttatcatattgtcttgggatatttatttcagcagaaatcctaagaccagaaagcctgggtattcctgggccaagggtctagaaagatggtgacaagttggttctggatcatggtatggggaggaggatggatgttcctaattcatattacagaatgtaaactgatagaagtgtgtgaatataaatatatattacattacacataaatataatagatgatatgttttaccatgattattttatatatactactatgtattggtatgtatcatgtaatagatatagttatatattatgtaggtgtatatattttttaataaaatagctgggcagggcggcttgtgcctgtaatcctagccttgggtggtgggagaatcgcttgaggccaggagttcaagaccagcctgggcaacatagcaagaccctgtctctaaaacaatttagaaaactagcctggtgtggtggtgtgtgcctgcagtcccagctacttgggagggtgaggtgggaggatcgcttgagcccaggaggttgaggctgcagtgagctatgatcacaccataagacccagtctcgaaaggaggccatgaggggaggggaagggaggggaggaaaatgtttataaaccccacagtaagtggcagatactgtgctaagcacttcacatgtattaacaagtattaatttaatccacagaacaactcctggtggagccatcgttagcccaattttacagctgaggaaaccgacatgcacagaagttacgcacattggatcaggccacacagctggtaagtggcagagctgggatatgaaggcagggagaacggatcctagtggccactgggaaggtgcaatatgtactaagacaaatatacttgcatatgttctcactcagcaaacatttattgagggccactatttgcccaggaaacccagatgagcaggaagacacgcgctcggggctggagacgtgcacacccggggaaggaggtgcacaggtgaggagctaggctgttgcagttcaaactggtatgaatgggcaggcaggacgcagaagcggggagagtcatctgccaggaagaggggcccgggaaggtctgggatggctttggatcagaagttcgttggatgtggccgaccgcgggtgcttcgggagcgatgggtgagttgatttggctctctggacttcccagccagcacctccccattgcccgcttcccagcccgcgtcctcagttcctccgcaaagtcagcttcgccgcagcccacctcccacccaggaccggccccaaagcccttctcgattacctcgaaaggatctccggcactgaagtcgaaggagaggatgaggtgaacctcccgcgtcgggggcagcacgagtgggaagggagtgttgatggctaaaccagcatccaccaggtggaggtgcttccggctgctcattatcttgtcccggatgccacctgtggtgcccaggaagaaagaggatcagctgcttctggggactgaaagcaagacttggaaatggaaggcagagagggggatgggaaaatgatcgttgtcagtgtagacagcagttgtgaggttgccaactaggagctgacttctctctcttcccagattcatatgttgaagccctggctgggtgcggtgcctcacacctgaaatcccagcactttgggggctgaggcaggtggatcacttgaggtcaggagttcaagatcagcctggccaacacagtgaaaccctgtctctactaaaaatatcaaaattagccaggcgtggtggcgggtgcctgtaatcacagctacttgggaggctgaggcaggaggatcacttgaacccatgagccggaggttgcagtgagctgagatcgcgccactgcactccagcctgggtgacagagcgagactctatctcaaataaataaacaaataaacagacaaacacatgttgaagctcttacctccagtacctcagaatgtgactgtatttggagacagggtctttaaagaggtaattaaggtaaaatggggtttttggcgtgaagttccaaatgaagctgccttctcagcagcaatatgtgagagtgttgttaacccaatgtttctgagacaggtctcggtcagtgtagaaagtttattttgccaaggttaaggatgcacaaccgtgacacagcctcaggaggtcatgatgacatgtgcccaaggcggttggggcacagcttggtttagacattttaggaagacccgagatgtcaatatatgtaagatgaacactggttcggtctggaaaggtgggacaactcaaagcagggagggggcttccaggtcacaggtagataagaagtgaatggttgcattctttttttttgagaaggagtctcgttctgttgcccaggcgggagtgcagtggcgcaatctccactcactgcaacctccacctcctggcttcaagtgattctctgcctcagcctcccaagtagctgggattacaggcacccgccaccatgctgagctaatttttgtatttctagtagagacaaggtttccccatcttggcaaggctggtcttgaactcctgacctcgtgatctacccgcttctgcctcccaaagtgctggcattacaggcgtgagccacgggccggccaacattctttagagtttccattagcctttccaactggaggcaatcagatacgcatttatctcagtgagcagagggtgactttgaatagaatgggaggcaggtttgccctgggcagttcccagcttgacttttccctttaacttggtgattttggggtcccgagatttattttcctttcacagcgtaaaccaaaaataaaatgataagcccctcccccccacccccatccctcccgtccccccgccaacaccctccccaactcctacccccccacaacaccaccccaaccatctgaatgaacccttcctcttggccagggcaccccagagttaacctgaaaacctagttctggccgtgacaggaagggagggtcagacatgcctcacgatgccctcctccctttggggatttaaggaaagctgaccagcatttaatatccacccagagcttaagtctgacaagaatcatttacaatctattctctctgaagcttgctacctggagccttcatcagttactggaaaggggtcctgatccagaccccaagaaagggttcttggatctcatacaagaaagaattcagggtgagtccacagtgcaaagcgaaagcaagtctgttaagaaagcaaaggggtgaaagaatcgttactccacagagtagggtgttacggaaagtaagaggagaaatgcaaccacctcctccttttgttatatataggaaaacaacaacaacaaaaaaacatggggagatgtgctctgctacaagtatttgtgataaaggattaattttcataattactctattttggccgggcacggtggctcacgcctgtaatcccagcactttgggaggccaaggtgggtggatcacctgaggtcaggagttcaagaccagcctgaccaacatggtgaaatcctgtctctactaaaaacacaaaaattagccaggcgtggtggcacctgcctgtaatctcagctactcgggaggctgaggcaggagaatcgcttgaacccgggaggcggaggttgcagtaatctgagattgtgccactgcactctagcctgggcaacaaagagcaaaactctgtctcaaaaaaaaaaaaaaccaaaaaccataattactatattttacaagaacttatattattatttttaaagcaaaattaggaatgcgtctgttctcaagatatcaggatatcaggacattcctgggtctgagtctgtttagtaaacattatgaatctgttcccttaaccataaccatctagaggctaggaatgcctaacttcctggggatacagcccagcaaggctgagcctcatttttcctagccctcattcaagatagagtcactctggttccaatgcctctcacacatctgcatgataaaactttgaaacattccaatagaatgactagtgctcttctaagaagaggggattagaacagagacacacatggagcaaagaccatacgaggatatgagaaggtggctgtctgcaaatcacagagagagtcctcagaaagaactcaccccacagacaacttgattttggacttccagccttgagaactgtgagaaaataaatgtctgtcgtttaagtcacccagtctgtgggattttgtcacagcagcctgagcagactaagacagtacctctgggaatggttcctcttgctgatgaaaagagtcaaactctggaaaatatttgaagaggtttattctgagccaaatgtgagtgaccaatggcccgtgacacagtcctcaggagatcctgagaacatgtggcctaggtggttggggcacagcctaggtttatacattttagggagatatgagacatcaatcaaatatatctaagatataccttggttcggtccagaaaggtgagacgacttgaagtcatggaggggtagaggtgaggggtgaggaggggtcgggggggggcttccaggttataggtagatttaaagttttctgattgacggttgggcacagtggctcacacctgtgcacctataatcccagcactttgggaggccaaggtgggcagatcatttgaggttaggagtttgagaccagcctagccaatgtggtgaaaccctgtctctactaaaaatacaaaaatcagttgagcatggtgacatgtgcctgtaatcccagctactcaggaggctgaggtggtggttgcagtgagccaagattgtaccactgtactgcagcctgggtgacagagcgagactccatcgcaaaataaataaataaataaataaaaataattaataaataaatatatggaaaataaaataaaaatatctgattggctattggtttaaagagttattagcaatagaaaggaatgtctgggttatgacaaggggttgtggagaccaaagttttatcacgtatatgatgcctccaggtagcaggcttcagagagaacagaatgtaaatgtttcttatcagacttaaaatctgtgttgaggtggctcacgcctgtaatcccaacactttgggaggccaaggtgggtagatcacgaggtcaggagtttgagaccagcctgaccaacatggagaaaccctgtctctactaaaaatacaaaattagccaggcgtggtggcgcatgcctgtaatcccagctactcgggaggcaggagaatcgcttaaacccaggaggcggaggttgcggtgagctgagatcgcgccattgcactccagcctgggcaaaaagagcaaaactccatctcaaaaaaaaaaaaaaaaatttgtgttgacatgactgctagtcagcttttcctgaattccaaaagggaggagggtataaggaggcatgtccgacccccacttcccatcagggactgaacccatttttcaggttaactttggagtgccctggctgacaggagaggtctattcagatggttgggtggtggggggcttagaattttatttttggtttacactctcatatattgctactgagaaagcgacttcatccaaccccttcagggagaaatttgatgctaaaacactcatcgccatgatccagtgacttgatgcttgatggtgtattccgaggccataagacccggcagctgcatggcatggtgcgcagacacagctgaagtcctgtgtgccttgtaggaagcaccccaggagaggtgagcaggactgacatccagccagggttcccttcccaggccacacacagccctggccaggggggcacattttggaattcacccccctggaagatgcaccttttctcgatttgcacaagggcaacaggaccacaaacataaagatgttcacgatagtcttgtaacaaaagagtggggaaggccaggtgtggggtggctcacacctgtaatcccagcactttgggaggctgaggtgggaggatcgcttgagcccaggggttcaagatcagtctgggcaacatagtgagaccccatctctatgaaaaagaaaaagaaaaattagccaggcatggtgctgtgtgcctgtgttcccagctattcgggaggctgaaatgggaggattgcttgagctggggaggctgaggctgcagtgagccatgattgcaccactgcattcccacctgggcaacagagcaagacacacacacacacacacacacacacacacatacacatacatgagtggtgcagggattggcatggtcataggagaggatctccaccagctatgaacattggagcttatggagactattaaatggcctcagtgtgagttcccaggagtctgacatcaattccacctgaatgagagggtcagtcccctgaagggaaaacccatacaaatgtgtgttgttttttttttttttagatggtgtctcgctctgttgccaggctggagtgcagtgggatgatcgcggctcactgcaacctctgcctcctgggttcaaacgattctcctgcctcagcctcctgagtagctgggactacaggcacccgccaccctgtccggctaatttttgtatttttagtagggacagggttttaccatgttggccaagctagtcttgaactcctgacctcaagtgatccgcccgcctcagcctcccaaagtgctgggattacaggcatgagccactgcgcccagcccatacaagtgtttttgaagaccaggtcctaggactagctgacaagaaattagggttttttgcatttttgcaaaaccagagaaagccatcagtgaggcttttcacgatgactgggactcgcagcgaggccacacatttttcagtatggaccacaccactgagcgaaagttcccctaatcagatccctgggccctttgacaccacccccctccaaagctctggggaaggaccagcctgggattgtttcaggcccacccccttcccctactccagcccattcacacgcaaggacagaccagggcggtgggaagagggtcttctcaccgtgtttgtacaggaagttgtgagtggtcccccattcccactttgaagcgcaaatgcctgttttcttcacaaaatccatcaagttactgagtgagcctagggaaagaagccgagacagccaaggtgagttcaggagactgagtggtttctgcccccaccaaagtcatatgtggaagccctcatcccccatggggttgtatctggagacaggacttttaaagaggtcattcagggccggcgcgttggctcacgccagtcatcccagcactttgggaggccgaggcagaaggatcaccatatcaagagatcgagaccatcctggccaacatggtgaaaccctgtctctactaaaaatacaaaaattagctgggcgtggtggtggcgcatgcctgtagtcccagctactggggaggctgaggcaggagaatcgcttgaacctgggaggcagaggctgaagtgagccgagatcgtgccactgaactccagcctgatgacggagcgagactccatctcaaaaaaaaaaaaaaaaaaaaaagtgggggggtcattcaggataactgaggtcatgagagtgggatcctaattcaataggactggggtctttatgagaagagaaagagtgccaggcaccagagtaatcccaggacttagggaagccgaggtgggaggattgcttgagcccagaagtttgagaccagcttgggcaagagagcgagaccacatctttacaaaaataaaataaaataaacaaattagctgggcatattaatgcatgcctgtggtcccagctattcagaaggctgaggcaggaggatcacttgaacccagtagttcaaggctgaagtgaactatgtatgattgtgccactgcactccagcctgggcattccagcctcacttgtatcactcagatcatttagatacaagggagaccttgtatctaaaaaaaaaaaaaaaagaaaaaaaggaagacaccaagaataccaagaatgcgtgtgcactgaggaaaggctgggctgagaggatgcggtgagaaggcggccatccctctgcaagccatggagagaggcctcaggagaaactgaccccactggcaccttgatcttggacttcctgcctgcagaattgtaagaaaataaggctgggcacagtgactcacatctgtaattccagcactctgggaggcccaggtgggtgggtcacttgaggtcaggggttcgagaccagcctgggcaacatggtgaaaccccatctcaaaaaaaaaaaaaaaaacggtgaggaaataaaagcctatagttgaagccaccccacttcaacttttgttagggcagcagagctgacaaatctggtgagctgggaaaggttggcatacaggggcctgggggtcctggccgtcagatccagcatctatcattgagccacaggtgagatgactttgagccattggggttgggggagttggcaaggaaaagatggcgatttaatgactgtatgatcacctgtgtatctggggaaatgagcttgttctctttaggttcatgggggagaacgacgcagaatgttccaggagctgttccaaaatgcccagcacactttcccgtgctcccttccccagcccaagaggctgccaagtcagtcagggataaaccaggtcattatcccagacgcctgcctcttcctcaccctcaccctggactatcaccaagacctgccaattccacctcctcttcagtgtctctgctcctcccaatctcatctgccagtaccttatgcagcatcttttccatccaggatgcaacactgcctccccctctgatttccctcttcctggtttttcagctccaatcctttctctgaacagcaggggcagagtggcaagagagcaaagctagtagggaggtgggtgcttgagctagatgctgatttgaatttgacttcatcactcattagctgtgtgaccctgagcaagttacttttatttatttattttttcttgagacagtcttgctctgtcacccaggctgtagtgcagtggtgcaatctcggctcactgcaacctccgcctcctgcgctcaagtgattctcctgcctcagcctcccaaatagctaggaccacaggcacccaccactacgcccggctaaatatttttttgtatttgtagtagagacggggtttcgctatgttggtcaggctggtctcgaactcctgacctcaggtgattcacccacttcggcctcccaaagtgctaggattacaaacatgagccactgcaccgggcccctgagcaagttacttaacatctctgttctcatctgtaaaaccaggaagagagtaacacctatcccttatagatttatgaggaataagtaagagcctgcctatagcacttaggatgttgggaggatggtttaacatgtcaactaggctgggccacagtaaccagttatttaatcaaacactagcctagatgtggctgtgaaggtattttgtagatgtggttgacagctaaaatcagttgacttcaagaagattattctcagtaatgtgggtgggtctcatctactcagttgaaggctttgagggcaaaacagtttctagagaagaagaaattctacctccagactggagcgtcaaattctgcctcatgcatgcgtatgctcattgcagcactattcacaatagcaaagacatggaatcaaccaaatatacccatcaatggtagactggataaggaaaatgtggcacatatacaccatggaatactatgcagccagaaaaaggaacaagatcatgtcctttgcagggacagggatggagctggaagccattatcctcagcaaactaatgcaggaacagaaaaccaaacaccacatgttctcacttataagtggcagctgaatgatgagaatatatggacacagggaggggaacaacacacactggggcctgttgagggggcggtgggagggaaaacatcagggtaaacagctaatgcatgtggggcttaatatctaggtgatgggttgataagtgcagcaaaccaccatggcatacgtttacctgggtaacaaacctgcatgtcctgcacatgtatcctcaaactttaaattaaattaaattttaaaaaatcctgtctcggtttccgcctgttggcctgccccatggattttggacttgtcatcttcacaatcccatgagccaatttgttaaaataaatatctctagttagatagatagagatagatagctataaatacatagatatagatgcatagatttgggcagacagagacatagataggtagatatagatagatagatatcttattggctctgtttctctgaagaaacctaacacatccagcaaatagtaggcacttaataaatattaacttctacaagagtttagcagcagaaaagcaaatcacacctacattgctttgatagccctttaatatttaacatgttaaagaaaactaaatgtggcctgaggactccatacttcttctttttttttgagacagagtttcactcttgttgcccaggctggagtgcaatggcgtgatctcagctcactgcaacctccgcctcccgggttcaagcgattctcctgcctcagcctcccaagtagctaggattacaggcatgtgccaccacgcccggcgaattttgtatttttgcatttttagtagagacagagtttgccatgttggccaggctggtctcaagctcctgacctcaagcgatccgcccaccttggcctctcaaagtgctgggattaaagccatgagccaccacacccggccattctatcttatatttttatttatttattttagagaggaggtctcactacgttgcccaggcttgctggtcttgaactcctggcctcaagcgaccctcccgcctcagcctcctgagtagctgggactacaggcgtgagccatcacacctggcttttttaaatgttttatctatttattaattttgtttaaaaaagatgaggtctcacagtgttttccaggctagtcttgaatacctgggctcaagtatatcttatagtaagttaagaattggccgggcacagtggctcacatctgtaatcccagcactttgggagcctgaggtgggcggatcacaaggtcaggagttcaagaccagcctggccaatatgatgaaaccctgtctctactaaaattacaaaaattagccgggtgtggtggtgcatgcctgtggtcccagctactcgggaggctgaggcaggagaatcgcttgaacccgggaggcagaggttgcagtgagccaagattgcaccaccgcactccagcttgggtgacagagcgagactccatctcaaacaaacaaacaaaaacaaaaaacaaaacaaaaaaaagtacgttttttaaaagaaaactttttaagggatgggggtctcactctgagtgcagtggtgcattcatagctcactgcagcctccaactcctgggcttaaggaatcctcccacctcagcctccccgaatagctgggactacaggtgcacgcaccaccatggccggctaggatgcatgttctcatttcagcacaggagccaggcattatagaaagtcatagtgaggcttcgtgtggcacattccatctctctccattacccaccggaggggtaaacccaagcctctcatctgccagactgaagtcagtagatgaactctggctgactttccccacatttccacttggtaggctcattgtcactcattcttcaagttgcttctgagctatcaccttggaaaaggaggcttcttcattaatcccatctaaggggagcttggccaacaatagctcagagacatcaagttaatagtcggctccctctttaaattgtagacaaaggaaaccagagaatagactgatttcatccaacagagataaaaacaggaatttatgtaacatgaataaaaggaggaggaagggaaatctagagtctgaagagagtacaccttgatttcctttccttggtgagctgctgatgagctggtcaggaggactctgggtgtgtctgtgcctggacaccgggtcatcacagaggtgagaggttggatgtctgggggtgagactggctgtacctgggtcatctcaggaaggcagtggcttcagcgaccaactgtcttcattgtccctcatccacgctacttcactctcagaatttttcaccggatacctgctctcgcctctccttgtctctccatataatttacttatttattattttttcgagacagggtcttgctctgtcacccaggctggaatgcagtggcacaatcatagttcactacagcctcgacctcttgggctcaagtgatcctcctgcctcagcctcctgagtagctgggaccatgggaacgcactaccatgtccagctaattttttacaaaaaattttgtagagatggggtcttgctatgttgcccaagctggttttgaactcctgggctcaagtgatcttcctgcctcagcctcccaaagtgctgggattacaggtgtgagccactgcacccagccctctccatagaaattagcccagtcggggatggacttgcctgtggttggcttacctgtctattctccatctcgtcctctagaccatgagtcctccaggcaggcacttggtctgacatttcccctttgtcacccctacccccagcctgctagtaggagagttattatttcatgctaatgactcaagacatcctagatggatggatggccggttgggtggatagagggtgggcgtatcagtccattcttgcattactataaagaagtacctgaggttggataatttataaagaaaagaggtttaattgtctcacagttctggatgctgtacaggaagcgtggtgctggcatctgcttctggtggggcctcaggaagcttccaatcatgatggaaagtgaatggggagcaggcacatcacttgccgagagcaggagcaagagagcgagggggaaggtgccacacacttctaaacaaccgtatctcacatgaactcagagcaagcacttactaatcaccaagaggatgacgctaagccattcatgagggatccgcccccatgatccaatcacctcccaccaggccccacctccaacactggggattacatttctttttcttttaatttaatttaatttaatttaattttaagttccgggacacatgtgcaggacgtgtagatttgttacacaggtaaacatgtgccatggcggtttgctgcacctatcaacccatcacataggtattaagccccacatgcattagctaattttcctggtgctcttcttctccccacccgcccccaacaggccccagtgtgtgttgttcccctccctgcgtccatgtgttctcatcattcagctcccacttataagtgagaacatgtggtgtttggttttctgttcctgcaatagtttgctgaggataatgacttccagctccacccatatccctgcagaggacatgatcttgttcctttttctggctgcatagtattccatggtgtatatgtaccacattttctttatccagtctatcactgatgggcatttgggttgattccatgtctttgatattgtgaatagtgctgcagtgaacatacatgtgcctgtatctttctaacagaatgatttacattcctttgggcatatacccagtaatgggattgctgggccaaatagtatttctggatctagatccttgaggaattccacactgtctcctacaatggttgaactaatttacattgggggattacattccaacatgagatgtggaagggaacaaatatccaaactgtaccagtgggacatctggtcatgtcccctgcaggactggcccacaggggtggggaagagcaagaggggggagaaggttggtggcacttactgttgatgacacttatcacactacacatggtacctttcctttcggggtcctcatggggctgctcctgcttttccagggaggtcctggtccaattctcgagcatctcagtcagccaggtgtgttcaggctcaccgccttcatctacgtcaagaaatccaggtggtctcagacactgtccaagtaccctaccaagaacatcacagaccctgctctgcctcatcttctgcaatgccctgcggttcctcctgaggtgacctccttctccaggtgaccctctctccccttgccttctgctgacccccatgttacctcactctctctgactttctggcctcttttttctagctccttcatctctgcctccacctctactcatcttttgcacgcttattttcttcagggttggaggcaaagtctcccatttatttatttatttatttatttatttatttatttatttatttatttgagacagagtattgctctgttgcccaggctggagtgcaatggggcaatctcagctcactgcaacctctgcctcccagtttcaagaaattcccctggctcagcctctggagtatctgggactacaggcacgcaccaccaccaggcccggctaatttttgtatttttagtactgatggggttttaccatgttggccaggctggtctcgaactcctgacctcaagtgatccacccccctcagcctcccaaagtgctgggattacaggcattgagctatcatgcctggcatcccctcttatttttatccacactcatgaattagatgatgttcaactctctctctctcacacacacacactgataatagctctgctcacgtttgctgagaacgtcacctgccaggctcatcttggcattttgcataaattctacacttcaaccttcaccgcattccttggagtgagctctctgaggcttcttttataagggattaatccaaatcaagagggctccaccctcatggtctcaacacctcccaaaggccccatctcttaataccatcaccttggggttgccatttcttttttgttgttgttgttgttgagacaggttgtcgctctgtcaccaggctggagtgcagtggtacaatcaccagcctaccatcccacaacattagttagccatttgcaggttggagatagattctccttccagacttgtctataaccagcatatggtgaatgctgatgtcaaaaaacaacattaaagcccgccatgtggcaagaagttggctctctgcaacccagaagagggttccccagaatccaaccctactggtactctgatcttgggcttccagcctccagaactgagaaattaatctctgttgttgctaagccagccagcctatgtatggcactttgttctggcagccttcacaactaaaacagggagggaggcatgaagtggatgaagggctgtgctcaggacctaccttcactctgtacctgactgttgacctgtgaaaaagccacacttgcatcttccacaactggaaggaagaccatctttgtcagcctctgctgtagttaggttggggccatgtgactgatcctggccaacaggaggtgtgtggagctggtgcccaatacttccaggcctggctacaaaaggccttctgtggcactccagctctctcctctcatggaacagacaaggagaccttgtgccaagaggagaagcaacgagatgcaagcagcttggcccagcgcggtggctcacacctgtaatcccagcactttgggaggcccaggcaggcagatcacttgaggtcaggagttcgagagtagcctgggtaatgtagtgaaaactcgtctctactaaaaatacaaaaattagccaggtgtggtggcagttgcctgtaatcccagctattcaggagtctggggcaggagaatagcttgaacctggaaggcagaggttgcagtgagctgagattatgccactgcactctagcctgggtgacacggctagactctgtctccaaaaaaaaaaaagaaaaaagaaaaggaaaggaaaaaaaagacgcaaacagcttggatgcctaagtccccacatggagccaagttgccctggaggaacactcaacccatatcgctttttgggtaagcaaaatataaaccctttgtgtcttaagctatagcaatttgtggtttctttgcgcagcatagcctctcctgaacaaatatagtctcctccataatataatctaacttctccatacagaattcatctgatactttgttcttgttctccgtactcccaccatgggtcaagtctgattccttcatgactcccaacctatgtagttttgggaagtatttttcctctcaatttgctaattgcctcaggctgttcccattttctgcctctgacacttggatcctaggcatacctagggtatatctgacgactatgtacatggatcctatggttagactcatccaaaaagctcctaggtctaatgaatgaattcagtagagtttcaggatacaaaatcaatgtacacaaatcagtagcactgctatacaccaacaatgaccaagctgagattcaaatcaagaactcaaccccttttacaacagctgcaaaaaaataaaataaagtactcaggaatatacctaaccaaggaggtgaaagactgctacaaggaaaactacaaaacactgctgaaagaaatcatagatgacacaaacaaatggaaacacatcccatgctcatggatgggtagaatcaatattgtgaaaatgaccatactgccaaaagcaatctacaagtccagtgtaattcctatcaaaatactatcatttttcacagagtgtcagtttgaactccgatcctgcccctcctggctgcgtggcctcaggcacctgggagagtccatgctcctctccattcccaaaggagcaccacatgaatcagacacgtaaagtttttaggacaatggctggcttcaagccagtgtgcagtccacactatcattagggattcatggcaaagtaggatgcttaccttctgggggaggatgttccccttgtgaactttcttgcagcctcagtaatcgggctgcaaaagagcagaggcagggggaatgtttaactgtaaagtcactagttatagaaaatacagattacctgcagcgacgtctctttaatagaaatggcagccatgggttggagtctgttgatacgggttctggagagctaattttgtacccgtcttccaactctgtgctcgctgacctcatgttggtagcttgaaatttgccatgatgtgatcaagtgggtttcatactaggaatgcagggatggcttaacatatgcaagtcaacaaatgtgatatatcacagaaacagaattaaaaacaaaaatcataggagatgcagaagcatttcacaaaatcccacatccctttatgattaaagccctcaacaaaatcggtatacaagagacatacttcaatgtaataaaagccatctatgacaaacccacagccaacattacactgaacagggaaaagtttaaagcattccccctgagaactgcaataagacaagaatgcccactcttatcacttgtattcaacatagtactggaagtcctagccacagccatcagacaagagaaagaaatgaagggtatccaaaccagtaaagaggaagtcaaactgttagtgttcactgatgatatgattgtacacctagaaaaccctaaagactcatccaaaaagctcctaggtctgatgaatgaattcagtagagtttcaggatacaaaatcaatgtacacaaacagtagcactgctatacaccaacaatgaccaagctgagattcaaatcaagaactcaaccccttttacaacagctgcaaaaaaataaaataaaatactcaggaatatacctaaccaaggaggtgaaagactgctacaaggaaaactacaaaacactgctgaaagaaatcatagatgacacaaacaaatggaaacacatcccatgctcatggatgggtagaatcaatattgtgaaaatgaccatactgccaaaagcaatctacaagtccagtgtaattcccatcaaaatactatcatttttcacagaacaaaaaatcctaaaatccttttttttttttttttgagacttagtctcgctctgttgcccaggctggagtgcaatggccaattttggctcactgcaacctctgcttcccaagttcaagcgattctcctgtctcagcctcccaagtagctgggattacaggcgcatgcaccatgcctggctaatttttgtatttgtagtagagatggggtttcgccatgttggccaggctggtctcaaactcctgacctcaggtgatccacccgccttggcctcccaaagtgctgggattacagacgtgagctaccatgcccagccacaatcccaaaatccatatgaaccaaaaaagagccctcatagccaaagcaaagactaagcaaaaagaacaaatctggaggcatcacattacccaatcaaattatactacaagcctatagttaccaaaacagcacggtactggtataaaattaggcatgtagaacaatggaacagaatagagagcccagaaataaagccaaatacttatagccaagtgatcttcgacaaagcaaacaaaaacataaagtgggggaaaggacaccttattcaacaaatggtgctgggataactggcaagccacatgtaggagaatgaaactcgatccttatttctcaccttatacaaaaatcaactcacaaattcaatgtgaatttgcatcaaagacttaaatataagaccagaaaccataaaaattctagaagataacatcaaaaaaactcttctagatgttggcttaggcaacgagttcatgaccaagagcccaaaagcaaatgcaacaaaaacaaaaataaacatatggatatatgggaacgatggctcacgcctgtaatcctggcactctgggaggcccagctgggcggatcttcaggtcaggagttccagaccaacatgacgaaaccccatctctattaaaaatacaaaaattggccaggtatggtgttggatgcctgtaatcccagctactcaggaggctgaggcaggagaattgcttgagtctgggaggcggagattgcagtgagccgagatcgtgctgctgcactgaagcctgggtgatggagtgagactccgtctcaaaaataaacaaatatatgggacctgagtaaattaaaaagcttctgtacagcaaaggaagtaattatcagagtaaacacacaacccactgaatgcgagcaaatatttgcaaactaggcatccacaaaagacgattatacagaacctataaggaactcaaagaaatcagcaagaaaacgaataatcccaccgaaaagcatcccaatgatatgaatagacatttctcaaaagaagatattccagtggccaagaaacatatgaaaaaaatggtcagcatcactaatcattaaagaaacgcaaatgaaagccacaatgagataccatcttactcccacaagaatggccattgataaaaattcaaaaaaaaccatagacgttggtgtggatgcggtgcaaatggaacactcacacactgctggtgggaatgtaaattagtacaacctctatggaaaacagtatggagagtcctcagagaactaaaagtagatctaccgttcgatccagcaatcccactactgggtatctacccaaaggaaaggcagccattatatgaaaaagacacttgtgggctgggtgcagtggctcacgcctgtaatcccaacactttgggaggctgaggaggggagatcactcgaggtcaggcgttcaagaccagcctggccaacatggtgaaaccccatctctactaaaaatacaaaaattagctggatgcggtggtgcacatctgtagtcccagctacttgggaggctgaggcaggagaatcacttgaacccacgagttggaggttgcagtgagattgcaccactgcattccagcctgggcaacagagcgagactctgcctcaaaaaaaaaaaaaaaagacacatgcacatgtatgtttatagcagcacaattcacaattgaaagatatggaaccagccgagcatggtggctcatgcctgtaatcccagcactttgggaggctgaggcgggtggatcatgaggtcaggagatcgagactatcctggctaacaccggtctctactaaaaatacaaaaaaaaaaaaaaaaaaaaaattagctgggcgcagtggtgggtgcctgtagtcccagctactcaggaggctgggccaggagaatggcgtgaacctgggaggcggagcttgcggtgagccgagatcgcgccactgcactccagcttgggtgacagagtgagactgtctcaaaaaaaaaaaaagatatgaacccacctaagtgcccattgacaaatgagtggatacagaatatgtggtatataaacaccatggaatatgactcagccataaaaaagaataaaataatgtcttttgcagaaacttggatggaggccatcattctaagtaaagtaactcaggaatgtaaaaccaaaaaccatatgttctcacttataagtgggagctaagctatgggtacgcaaaggcatacagagtggcataacggacttcagagattcagaaagaggagggtagggaggtggggataaaaaactacacattggggccaggagtggtgggtcatgcctgtaatcccggcactttgggaggccgaggcaggtggatcacctgaggtcaggagttcgagaccagtctgagcaacatggagaaaccctgtctgtactaaaaaaatacaaaattagccaggcatggtggtgcatgcctgtaatcccagctactcgggaggttgaggcaggagaatggcttgaacccaggaggtggaggttgcggtgagcagagatcgctccattgcactccagcctgggcaacaagagtgaaattccgtctcaaaaaacaagaacaaaaacaaaaaaacactacacattggggccaggtgtggtggctcatgcctgtaatcccagcactttgggaggctgaggcgggcagattgcttgagctcagaagttcgagaccagcctgaccaacatggcaaaacctcatctctactaaaaatataaaaattagccgggcatggtggtacgtgcctgtaattccacctactagggaggctgaggcaggagaagcacttgaacccaggatacagaggttgcagtgagacgagatcttgctactgcactccagcctgggcaacagagtgagactgtcacaaaaaacaaaaccaaaaaactacatattgaatgcaacatactctaaaacatacactgatgggtggactacagtctcagaatttactactacataattcatcgtgtaacagaaaccacttgtaccccaaaagctattgaagtaaaaattcaaaaaaaaacaaaaaaatcttaatatttaaaaatattattacctaatagtagcagtgttgatccttataattaaaatattgtacatgttataactttttacttgagaccaaatcaaaattcaatttttccacatgtgctgaaaatgcgatagaaagctaagtcctgatacacgtcggttaggtcaagcttctgcttcatctttttcaaatttttgaattgtcaataaataaattttgtctgcttttttttctttttctttctttctttcttttttttttttttttttttgagacacagtctcgatctgttgcccagcctggagtatagtggtgcgatctcggctcactgcaacccctgcctcccgggttcgagcaattcccctgcttcagcctcccgagtagctggggttacaggcgcccgccaccatgcccagttaatttttatatttttagtagaaacgaggtttcaccatgttggctgggctggtctcggactcctgacctcaagtgatccacccacctcaacctcccaaagtgctgggattacaggcgtgagccactgtgcccggcttgctttttctttctttcttttttttttttttttgagacggagtctcgctctgtcgcccaggctggagtgcagtggctcgatcttggctcaccgcaaactctgcctcccaggttcacgccattctcctgcctcagcctcccgagtagctgggactacaggcgcccgccactacgcccggctaattttttgtattttttagtagagacggagtttcaccatgttagccaggatggtctcgatctcctgacctggtgatccacccgcctcggcccccacaaagtgctgggattacaggcgtgagccaccgcgcctggccctggcttgctttttctaacaatacaagacataataaaaataatattgacatttaagaggacactcccatgtgtcaagctttgctctaagtactttacatacatgaggtcatttaaaccccacatcaaatagtacatagtcccaatcttgtatatttgatgtatatttacatttatttgatataaatatacaagattggggctatgcactattgtatccattttacaaaggagaaattgggtcacagagaattttgttgttgttgttgattttcttttctttttttttttttttttgtttgtttcatttcttttttttctttttctttttcttttttctttttttttttttgagactgtgtttcactcttgttgcccaggctggagtgcaatggtgtgatctcagctcactgcaacctccacctcctgggttcaagcgattctcctgcctcagcttcccgtgtagctgggattacaggcatgtaccaccacgcccggctaattttgtatttttagtagagatggggtttctccacgttggtcaggctggtctcaaactcctgacctcaggtgatctgcccacctcagcctcccaaagtgctgagattacaggtgtgagccactgcgcccggcccctcatttctttattttttaatttttttcacagagaatttaagcagctttctagggtcactaacgcatgagaggtggagctgggatgtggattcaggcagacaggctttggatcagaaccaccatacgattcccctatagatccctgtgtctgcactcaccaaccagttacataggtgagtcacgcatcctttccatgacccggtggctctcagcaaaatggaggggacaacagcatccacttcttcaggtcattcaaagggttaaatgatgaacaggtaacgaatgccaattttgtgtgtgtgtgtgtgtgtgtgtgtgtgtgtgtgtgtgtgatggagtcttgctctgttgcccagactggactgtagtggtgtgatcttagctcactgcagcctttgcctcctggtttcaagcgattcttgtgcctcaacctcctgagtagctgggatcacaggcgtgcaccaccatacttggctaatttttgtatttttagtagagacgcattttcaccatgttacccagcttgcactcgaacccctgacctcaagtgatctgtccgcctgggcctcccaaagtgctgggattacaggcatgagccactgcgccgggccaggctgcttgcatcttgttgcccaggctggagtgcaatggtgtgatctcagctcactgcaacctccgcctcctgggtttaagagcttctcctcttggcacaaggtctccttgtctgttccatgagaggagagagctggagagccacagaaggccttttgtagccaggcctggaagtagcaggcaccagctccacacacctgttggccaggatcagaaacctgaactcctggcctcaaatgatccgcccgccttagcctcccaagtgttgcgattacgggtgtcagccactgcatccagccagattgctaatgtttactgagtgcctttatctaccagacactgtcctatgtgcttttgatgaattaactcatttaatcctcataactactattattatcacccacatggcacagaggcagaaactgaggcacagagaggttaggtaacttttcagaggtcacaaagctcacatgtaccacagcaacattccttccaagggtgtctgtactctcatccactctgtggtcttcctggctgcccataatcaatgttcagtgtatgagaataaatgtcaggaaatgtggttgttagaaccattatacacaggcctcttttctgccacatgcaggaaaagtactgtgaatctccttgcataaaatatctctaggctttgacctttctgttccccaaatactcaccaaaaataaggtgtccaatgcttttagcattagcaacagcccttctccataaacctgccaagaaaatagcaataaaattcaaacattctccatcacatgactgtcatgtttgatattcaaagcaccagcagactggcataaagcactgcagggatctgcagcaggaagaaagatcattcttccattccataaatatttatgaagcaatcagtgggcacccggcactcttctgactgttggaatagagcagtaaacaagacagatttgtcctcaggaaccttctatgggtggagccagccgggcactgtagactggctaccccaaggccatttcaagctcccttccatgccaacgtttctcagcccacaggcaggaagggcaaatatttcccagcctcccttgcagctagagggaggtcaagctctggcccatgcagatttatgggggcacttctggaaagtcctagctgtcctactatgaaagagcaggacagcaaacatgttggattagaggcattgctggcatacccctcccacttggaaggacaaaacactgtgtagagattcacactgtgaacttttttttcaagaagtgattcaggaattagacaggaaatctgaaggaatccacagtccctttgaaggaagtgacgggctgcagcctatactgtgactcaagtgaagggctgcgagtccccagggtgtgagatggggaaagactgtttgcaggacacacgcccccaccacaccagggagcctgaaagtccagtctctggggtaaggccttaaccctattcagtgcaggatatgacttggggaggttcgtggaatataagtaggagctgtgggaagaaccctgcatgcactcccagatcccagtatggacccagggaagccattccttattgttcctcacagggcaccctgcagtggtcagccaaaaagttcaggtgggtggtcgcaggttgaaagaagcccccagctgggtttcatgagataactgtgggtggaggtgaacttctccacccacatggggtgaatgaaaagcaagctgcagacacgtgtgcaggaccctggcacatggctaggtgggatagatggggaggggcatggcctgagagcagtggttgctatctctgcagggaaagcttatgacttgggggcatttgcaagttctgagcacaggctgcctggaacttagctcaccactgccagtggaacagggtgggaggggatctgcctcgccaagtgtgtgggatccgcgtggggcttactgccacctgccactccccactccctacacaaactcttctgtgcagcagaggcagaaacattcctctctggattatcagcacatgggtctgaaaaccacccccaccccctgatacccacaggagctgctgcttgccctgcacagggagagttagagcacaaaactgcctgacccagcccacacctggctttgccctgccacccgccctggtggctttaatacaaaggacggaaacttttgggaactctgtggctctgcccattgcctgagaaacaagagtagccaccctgggcaacatagggcaagtgaatatcccactgctactactgcagctggtgctccacctgctgggtggaggccaaccaacacagtccatgacagcatctcctggtaggataacactgggcccaggaaggagaaaatggctctatgtcctcagctatcaccactgcatgcaccactctggctaaccaggaggtcctgagtctgtccacatgatcagttcattactactataactagcattcaaggaagccaacctactaaggctgtccatcagcaaggaatctcacagagcctgtgtctctctcctgccacccccattagagctggtgctgcttcccattgctgggagtctcgaggacaggggacattaccggattccttggagacattcccaagaaccagcctgaagtgtggcagcttcactgggtggctagacccagaggaacaataacactcactgtagtctggtgctcagtgactcctatcctaggggaatggggagtgcaccacatcaagggaacaccccatgggacaaaagaatctggacagcaggacttgaaaatcagatctttctgctggtgggaagtttctttcagcagggacacagtttcagtgctgggctcagcacggaaagcccacagctctaacccaaccatcagacagccctggtgtgcatgaagggtcttggataaggggatgtctttcccctctcttccactgccacaggcacagttggggtttctcccatgggagctcagcatgggtacaactatagacagcctttctggaacatatcagggcgactgcatccccacaggaggagcccctctaggtttaggcttgcataagagacagattcacagttcctctctactcagaacaccaacattcctacagatgaaaagaggtgcccgtctgatctgaatagctggagcactggatcacgagtgtgtctgagagatggatggctttctggctgacctggcaggggagctgaggtggctccaacccttctgcctgataagaccacggtgcacagccaggcatggtggctcacggctgtaatcccagcactttgggaggccgaggtgggcggatcacctgaggttgggagatcgagaccagcctgaccaacacggagaaaccccatctctactaaaaatacaaaattagctgggcatggtggcaagtgcctgcaatcccagctactcaggaggctgcggcaggagaattccttgaacctgggaggcggaggttgtggggtgagctgagatcatgccattgtattccagcctgggcaacaagagccaaactctgtctcaaaaaaaaaaaaaaaaaatctcgatgcaactcactgagagctcctccagccacctctgtcaaggctgggacctttgctcaccattgggtgttgcatttactcacatgttttggccacaatcacttcctatgcactcccctacagacctgaagcctgaaccatcaaaccagtcaataaaatactggggaaaaaattgcatgccttgtggggaatgagttaagcttcaagagtcttctaccattccagccctgtaggcaacagtgaacttgctcacacagtgagcacatcgcttctacaaccagcatatgagaaagccatcacacgaagactccctatatccaaggaactcttacaatcttcacccctgaaagcaccaaggaccaaattaggctataattagctagggacattaaagtcacatccttaagcggaaaaaagaaaaaaaaaacacagtcaaatccaacataaattcaagaataattaaaagaaatagtctactcaaatgagaaggaatcagaaaagtaactttggtaatatgacaaaacatggttctacagcacccccaaaagatcacactacctctccagcaacagatccaaatcaagatgaaatctttgaaataccagataaagaattcaaatgggcaccaaatgaatcatacatgtaatgttcctaggacaatggctggcctcaagcaagtgtgcggtccccattatcatcagggattcatgatgaagtaggatgcttacctttcagggtcagattccttaactggtctgcaaaagagtagaagcaggaggaatgtttatctgtacaacaaagtccctagttataatataaaaaatacagatgacctgcagggatatttcattaatagaaatggcagccatgggctccaatggcagccaatggctctcgagagccaattttgcacctctcttccaactctgtgctcagtgacctcatgttggtagcctgaagttggccacggtgggaacatttacaccacaggaattggcaaacactacatatcaggaattttgtttttgttttttagagagaaagcttagcagacccactggagaagtaacactcagacccatctcacacctttagttagccatttggaggttggatatagatagattccctttttagttttgtttttaaccaagctatggtgaacaccaatgtcaaagaacaacatcagcccgggcgtggtggtttatgcctgtaatcctagcacactgggaggctgaggcagtgaatcacttgaggtcaggagttcaagaccagcctggccaacatggtgaaatcctgtctctaccaaaaatacaaaaattagccaggcacggtggtgcgcgcctgtagtcccagttactcgggaggagagttgcttaagcctgggaggtggaggttgcagtgaactgagatcataccactgcactccagcctgggcaacagagcaaaactctgtctcaaaaaaacaaacaacaaaaaaagtcaaagtgtaagaactaggacagtgcctggcacacaggaggtcccatgaatatacattaaatgaatgacgagtggtttagggtgtgaactcagtaatgatcctaaaaataagattaacatgtaatgaaacactcccatgtgtcaggcttggctctaagcattttacatacatgaggtcatttaaaccccacatcaaatatacgagactgcgactacgtactattgtctccattttaggaaggggaaattgggtcacagagaatttaagcagctttccagagtgagcagtgcaggagaagcagagccgggatgtggatccaggcagacaggctttggatcagaaccaccacactattcccctagagatccaccacccagttctcctatagatccccgcgtctgcactcactgaccagcagtgtgggtgagtcacgcatccttcccacgacttggtggatctcagcaaaatggaagggacaaaagcgtctgcctcttagggtattaaaggggttaaatgttaaatgagggaccaggtaatgattgctaatgtttactgagtgccgttatctaccaggcactgtcctacaagctttcaatgaattaactcatcaaatattcataactactgttattatcacccgcatggcacagaggcagaaaccgaggcacagagaggttaagtaacttttcggaggtcacaaagcttacatgtaccagagcaacattccttccaagggagtctgtactctcatccactctgtggtcatcctggctgcccaattatatgagaataaatgtcaggaaaagcagttgctagaacaattacacacaggtctctcttctgccatgagtaggaaaagtactgtgaatctccttgcataaaatatctctagggtttgacctttctgttccccaaatactcaccaaaaatgtattccctaatgacttcagtgttaccaagagcacttccccataaacctgccaagaaaagagcaataaaattcaaacattctccatcacgtgactgtcatgtttgatattcaaagcaccagcagactggcataaagcactgcagggatctgcagcaggaagaaagatctttcttccattccataaatatttatgaagcaattagtgggcacccggcactcttctggctgttggaatagagcagtaaacaagacagataaagtccttgtcctcacgaaccttctatgggtggagccagccgggcactgtagactggctaccccaaggccatttcaagctcctgtccatgccaacccttctcagcacacaggcaggaagggcaaatatttcccagcctcccttgcagctaggggacggtcaagctctggtccatgcacactgctggggggacttctgcaaagtgcttgttctccttctcagaaggagcaggccaggtatggtggcatgcaactctagtctcagctacttgggaggctgaggcaggaagatcacttgaggccaggagttcaagacctgtattgggctatgactgtgcttttgcacggcagcttgagtgacagagagagaccctgacttcaaaaaaaaaaaaaaaagttgcagcttcattggatgcagccgccatcccgtggtgtggaggagttcagcatgagggtgacttaatatgctaaggatggaggagcagaaaatctagaataaacctgggtccttctgcttaatgttgcacagctaaaccaatgtcaccagccacctaactttgtattatttatttattttgagatgggatctcgctctgttgcccaggctggagtgcagtggtgtgatctcggctcactgcaacctctgcctcccagattcaagtgattctcctgcttcagcctcccgactagctgggattacaggcatgcaccaccacgccctgctaatttttgtattttttaagtagagacggggtttcaccatgttggcccgtctggtcttgaactcttgacctcaagtgatctgcccgcctcggcctcccacagtgctgggatttcagctgtgagtcacggtgctcagtctgtctttttcttttgtaagaaaattaatcccacatgtcctcggggcactgtggttggttagtgacttttagccaaacacatttgtatatgatacagggagacataaaaaatgaataatcagccaggcacggtggctcacgcctgtaatgctaacactttgggagactgaggtgggcggatcaattgaagtcaggagtttaaagtcagcctggctaacatggtgaaaccctatctctactaaaaaatacaaaaattagccaggcctggtggtatgcacctatagtcccagctacttgggaggctgaggcaggggaataacttgaacctgggaggttgcagtgagcagagatcacacaactgcactccagcctgggagacagagtgagactccatctcaaaaaaaaaaaaaaaaaaaaaaaaaatagacacacccattaggatggctggtatccaaaaaaccccagaaaacaataagtgttgatgaggacgtggagaaattggaaacctgggacaccattgggcagaatataaaatggtacagccactgtggaaaatggtatggtcgttcctcaaaaaaaaaattttttttttttttgagatagcccaggctggagcgcaatggcgcgatctccgctcactgcagcttccgcctctcgagatcaagagattctcctgcctcagcctcctgagtaactggaattacaggcatgcaccaccatgcccggctaattttgtattttttgtagagatggggtttcaccatgttggtcaggctggtctccaactcccaacctcaggtgatccacccgcctcggcctcccaaagtgctgggattacaggcattagccaccacacctggcctcaaaattttaaaagtagaattaccacatacatgatccagcaattctacctctgagtatatacccaaaagaattgaaagcagggtctcaaagagatattcatagacccatgtgcatggcaggttccttcacaacagccaaaaggtgaaagcaatccatgtgtccatcgatggatgaattgataagcaaaatgtggtatattcgtacaatggaatatgattcagccataaaaagaaaggaaattcagacacatggtacaacatggatgaacttcgaagtcattttcctcagtgaaatcagacagacacaaaaagacaagcactgcatgattccatttacatgtcatactcagagtagtcaaaatcgtagaggcagaaggtagcattgtggttgtcaggggctaagggagggggtgacagggacttagtattcaatgggcgtagagttccagttttacaagatgaaaagtgttatggagatggatggcagtgatggttgcacaacattatgaatgtattgtatttataccactgtacttgacactttaaaatggttaaaatggcaaattttatgttatgtttattttataataataaataaaaagcaccctggtgtgtgaggggagggataaaatacacgtacagaatcccttcagtaggtgatacatacatctaaggaaataataatgttatagggagtacctgggagtgacaatttcaaaatctctgatgcccaagaccagatttagcaaagagatggtggggataggagacaggagccaggcttggcaatgtgaaggaccccgtctgtccagaccagagaaaaggggaagatccccttcatcctaccttgttctcctcccctgagaacacccctccatctaccaggttgcagaagctggaacctttgatgtcatctctgattctccttactctccacatccaatccaggtgtaattcttcttcatccatctccaggtttccagagtccatccacttccctcccatatccattctggtacccaaccttaaactgccattatctgtcaccaggaccattagcttctcaactgctcccaacttctaagtttacacacccacccctaatccatgctcagagagagagagagagagtgagatgttttaccatataaactgaatcggtcaccaccctaattaaactgcctccctggctctcctatcgcacttggaatccaaactaaacttcatctgtgtccttcagggtcccatatgatctggaccctgcctacctctctagccctctctctcagcctcattcaggaggctccagcctcactggtcttctcattggttctagagtaagacaaacttggtcctggcttagggtctgatatggttaagctttatgtccccacccaaatctctcgagttgtaatccccagatgttgagggagagacctggtgggaggtaatcagatcatgggggcagatccccccatgctgtactcgtgatagcgagtgagttctcacgagatctgatggtttgataagtgttgggcagctcttctttggcttgctcttctctctcctgctaccacttgaagaaggttctttcttccctttcaccttctgccatgattgtaagtttcctgaggcctccccagccatgtgaaactgtgagtcaattaaacctcctttgtctacaaattacccagtctcgggtagtatctttatagtagtatgaaaacggactaatacagggtctctgcatttgctcttccctctgtccatgatgcttttcctctaagatatctgcatggcttcacttttcatcaggtccatgctcaaaggccatctcctgtcagaagctctgaccaccaattaaaaataatactgtagtcactctccagtcccttaccatgaattatttttcaagatagcatttactatgatctgacattataatacatacttatttttgtgtgtgttcattcatcatctccttccctggagtgcaaacttcattagggaatgagccttcactgtcctgctcatgactgaatcccctgcatttaaaatagtatcaggctcctagtgtgtctcaaaagtgtatgctaaaatcatggagagtcaaccatccttaatttcctaccatgtgctggacactgggctgagtgttttatttgtggatcatacctaactctcacacccacattttgaggtaagtactttccctatgagaaaaacgaggctcaggtaacattaatgactttctcaagctggcatggttggtcctatgtaggggagctgtctgcccagcagggtaatgccttcagaccctgaatgctgagaagattatgaagccacaactaaaagtgataccagtgtgtaagctacagtcaaggacatttaatcaagttctgattttactcactatgactgttttgtttttggtttttgttgtaattttttctggaaataccccatttaaaaaaaattgtatgccccttgctttgctggtgcccaaaacacattctagttttttgtttgtttgtttgtttgtttgtttgttttgagacaagatctttctctgtcatccaggctggagtgcagtggggcgatcataactcactgcagccttgaactcccatgctgaagtgatccttccactgcctcagcctcctgagtagctgggaccacaggcacatgccacaatgcctggctaatttttaaatcttgtgtagagacacagtgttgctatgttgccgaggttggtctcaaactcccagtctcaagggatcctcccaggtcagcctcccaaagcaccatgtaatcccaaacacattctgaatctgcttattggaagccacagccctggacttgagcccctctattaagctccctctcctggattgtttgataggatatcaggtatctgccgcattaaggagacctttgagagacactgaagactcagcagaaggaatacaccattcctctttctggaagcctaccaagtccttttctttcccccaagaaatttaagagctgggcaaactagaccctcagaaggaaaattcttgcctctcctccacttcccacccccttttaatcccctctgaccccagcgctgacctctcaggaaagtcaggtctctctcagggtgagttctgaccagtcttcccttcttgaatttgcttccgaagtgggttatggaaacaaaggcccccagtgcagagaagccagcgtggtgaggggtgaactcgaaccaggtctctgcagaggaaatacaacggcaagtgagtcccagcacagaaccaggaatgtagcaggtatgcaggaaaaagaaatctattaatgaggaattacaaccatgacaggagaatgttagagatggactgtgtggtatcagaaaccactggggatctcatcctcagacctgagtctacgctgctggtggcagctcataacttccacagcagcctgtttccaatattttccagagcttgaaccctcagccctgcctctctcttccatctcattgtggctgcaactccatggaatcctggagtgcaagggaagagtgtagccacacgattgcatggaggattgtctgtgggcataaatctaatgcatgattccaatgtgagtcattagaatattccagggaagaaaatgacatgatcagattttcatcctggaaacttccatcaggtagccagggaaggaggtggacagcttgggatgggcgggccagtgaggaactaattacaagagtctcccaggagactgggagacctggtctggggatgatgtagaagagcacaaaggatgaaaatgaggagggggtgatttctaggtctgggaatgactgaatttgtggggcttatggaaaggacggagtcagctgtatctgctctggtgagaaaacagcacaaggatccacaccgaggagagagataaaacattcatggccgggcgtggtggctcacgtctgtaatcccagcactttgggaggcggaggtgagtggatcacctaaggtcaggagttcgagaccagcctgattaacatggtgacaccccatccctactaaaaatacaaaaattagccaggcgtggtggtgcatgcctataatcccagctacttgggaggctgaggcaggagaatcacttgaacctgggaggcagaggttgcagtgagccgagatcgtgccattacactccagcctgggcaacaagagcaaaactctgtctcaaacaaacaaacagacaaacaccattcacactgggggcttctgagccttgagatgccaggagacgcccaaccacaggtaactggtaacattgcctgatgtatcgtgagaacttaccaggacacagttgctgaacaagtgagtgcattttatgcttaggaaatagggtaaggaggtctggatctcaggagagagatgagctcaaaagagaaactggaatgtctggagagctgccagcatttgggtgataatcggacctatggagaaggaagacatctaaaaagtgagagatggccgggtgcggtggctcatgcctgtaatcccagcactttgggaggccgaggcgggtggatcacctgaggtcaggagttcgagaccagcctgaccaacagggagaaaccacgtctctactaaaaatacaaaattcgctgggcgtgatggcgcatgcctgtaatcccagctactcgggaggctggggcaggagaatcgcttgaacctgggaggcggaggttgtggtgagccgagatcgtgccattgcactctaacctgggcaacaagagagaaactccgtctcaaaaaaaaaaaaaaaagtgagagacagccccacccacccaccccgccatccttcaaacatcccttattacagttttctttacttttttcttttttctttttttttttttttttttgagacggagtcttgctctgtcgcccaggctggagtgctgtggcgcgatctcagctcactgcaacctccgcctcccgggttcacgccattctcctgcctcagcctcccgagcagctgggactacaggcgcccgccgccacgcccagctaattttttgtatttttagtagagacggggtttcactgtgttagtcaggatggtcttgatctcctgacctcgtgatccacccgcctcggcctcccaaagtcctgggattacaggcgtgagccactgcgcccggcccctttttgtcttttgtccctcctctcctctgttttcttttttctttcttctttttggggggacagggtctcactttgtcactcaggctgtagtacaatggtgcaatcacagctcaccgaagccttgaattcctgggctccagtgatcctcctgccccagtctcctgggtagattcttcaggttcctgccaccatgcttggctaatttattgtgtttttttgttttgttttgttttttaatgttgttgttttgagatgggatctcactatgttgcccagggtggtctccaacttctggtttcaggcgatcctcccacctcagcctcccaaaccactgggattacaagcgtgagccaccatgttggcctcttaaaggttttcttgatccatgcaaagcaagtgcatgtcctctggtcacttctgggacttccctcttctctcgtctaagctgagcaccctgttttctgcaatcctgagcccttccctcttcctgggctccccaaggggagggcagggaaacattcttccattccactccgtgctgttccatcccttactacctctccctccctctaaatgtttgcttacctggtgctcttgcctcctgccaggaaggttgcaggtcattgtcaatggctgcaaatattgggtagggtagtgtcccttcttccacgggcttcttcatattggacaaatgagactccggcagctttgggagaaggtgccaagacagtgtgagggaggcatgtgggtcccacagggtggaacctctgcacgtaggccacatttttttttagaggggtctcagtctgtcacccaggctggagtgcagtggtacaataatgggccactacagcctcaacctcctgggctcaagcaatccacccacctcaacctcccaagtagctgggactacagatgcatgtcaccatgcccggctaatttattttttgatagagacaggcttttgctatgttgcccaggctggtctcgaactcatggcttcaagcaatcctcccgcctcagccacccaaagtgcttggataggctaggtgctgtggctcatacccataatcccagcactttgggaggctgaggtggaaggatcacttgagcccaggatttggagaccaccccgagcaaaaaagcgaaaccctatctctaaaaaaaaaaaaaaaaaaaaaaaaaaaaaaaaaaaaaaatttgtcaggcccagtggtgcgtgcctgtagtcccagctacttgggaggctgagctgagaggattgcttgagcccaggaggtcaaggctgcagtgagctgtgattgcaccactgcactccagcctggacgacagagtgaaaccctgtctcaagaataaacaaaacaaacaaaaaacaacaaaaacccgatgtgttaggataggctggatgcagtggctcatacacgtaatcccagcacttcgggaggctgagataggaggatcacttgaacccagtagttggaggattgcttgagctcaggagtttgagaccagcctgggcaatatagcaagatccctgtctctacaaaaaaaaaaataattaaaaattagccaggcacgatggtgcatgcctgttgccccagcttactcaaaaggctgaggcaagaggattgcttgagcccaggaggtcgaagctgcagtgagccatgatctcgccactgcactccagcctgggtgacagagcaagaccctgtctcaaaaataaaatgaaataaaataaaatagtgaattcaagacatcaaatggccaagcagagatggagaggaaagttgtcttgggtctgacactttccctatttctgccttattccatcataagtcctcattgttcttcttgccctggatgtctgtgtatctttctagtaaatcatatcactttatttgttgcataaacgaatcagagtcaatttctgtcacttgcaaccacagtaatcctgatatactttagttttgaggcatcaaccgaagtgcccagattttgatgacttgaaaatcctgaaggacttaaaaggtggtgctggtcagcatctttggtaaccccacaccctgagaccccttgctcctacccccaccccaggtccccagctgggaatgacttacttctctggtttgcttagagataaccatgtaggcccagaagtcggtcagagagtaattctcagacctcgctgcttggatggttttctgtaggctcttagccaagtcccactcctgtcgggtaaatcgatgtttcaggtcagcctcgagagcttccatgtcaccatcattggtgtagagagaagatattgccctggaggacagaggaagagagtgagttgggcattttaagtgtggacgatgaagactggggaaagatgtgtgcaaggaggtccttcacaggaacacctgcctcatggagagggcgacacacagaggaaacggaaaatttccattaaataaatacaactgcagaacgatcaagttcgaaggaggactcaaaatcatctgggacaatccttccatttcacaggcaggaaaatgagagcacgatgggagaaaggcctcatcagagtcaaatgttttttgcagccagcacttattaaaaggtttatatgtgacagcaacaaactgtctttagtcttttatacctattaactcacataatcctagaaaatcaatgaacggggccaggtgtggtggttcatgcatgtaatcccagcactttgggaggacgaggcgggaggattgcctgaggtcaggagttcgagaccagcctggccaacatggtgaaaccccgtctccactaaaaatacagaaaaattagccaggcgtggtggcatgcgtggtggtgggtacctctagtgccggatactcaggaaaccctgtctctactaaaaacacaaaaattagccaggcatggtggcacacgcctgtggtcccagctgctcaggaggctgaagcagaggaatcgcttgaacccgggaggtggaggttgcagtgagctgagattgtgccactgcactccagcctgggcgacagagcgtgactccatctaaaaaaaaaaaaaaaaaaaaaaaaagctgggcgtggtggcttacgcctgtgatcctagcactttgggaggccaaggtgtgcggatcacgaggtcaggagatcgagaccatcctggctaacatggtgaaaccccgtctctactaaaaatacaaaaaattagctgggtgtggttgcagacccagctactatagtcctagctactcgagaggctgaggcaggagaatggcgtgaacccgggaggctgagcttgcagtgagccgagatcgcgccactgcactccagcctgggcaacagagcaagactctatctcaaaaagaaaaaaaaaaagaaaaaaaagactttatattcatttgttcactcaataaatatatattatatatattaatttataaagaaaagaggtttatttagctcacagttctgcaggctgtacaagaagcatggtgcaaaaagcttctactcatggcagaaggcaagggagctggtgtgtcacatagagtctatatatatatatatatatatatttttttttttttttttgagacaggtcttgctctgttgcccagactagagtgcagtggcatgatcttggctcactgcagtctcaaacccccaggctcaaatgatcctcccacctcagcctcccaagtagctgggaccactacccaccaggtgcatcaccatgccctgctcatttttaaatttattttctgtagagatggagtctcactatgttgcccacgctggtctcaaacttgtggcctgaagcaatcctcccacctcagcttcccaaaatgctgggattataggtgtgagccaccgtgcccgggctcaataaaaatttttgatgttcttaatgctgcttatcgggtgctatctaccctcacaccatccaatgtattaaacatacatcatagctcttgagcccctgaagtgtggctagcatgatttaaaatatttatttcattttaattagcttaaatttaaacactggtactccattcagttattgggaaactctgaagtatgtttggaacaagctgggtatgaaaagttctttcctttaatatctttttttttttttttttgagatggagtttcactcttgtcacccaggctgaagtacagtggttcgagctcggctcactgcaacctctgcctcccggattcaagtgattctccttcctcagcctcccaagtagctgggattacaggtgcgtgccaccacacccagctaatttttgtatttttagtagagacagggtttcaccgtgttggccaggctggtctcaaactcctgacctcaggtgatccacctgcctcggcctcttgaagtgctgggattacaggtgtgagccactgccccgggcctcctttaacatctaatgagacttctgcatccaacttggaatgcgctcagtataaaacgcccagcagctttcaaagacctagtctgacaaaaggaatgtcaaatatctcattaacaatttttttcttaacgatgtgtcaaaatgctaatgttttggatatattgggttaaagaaaatggatcatttcactgtttctttttaccttcttgaagaggctactagaaaatttaaaatgggccggacatggtggcttacacctgtaattccagcactttgggaagccagggcaggcagatcacctgaggtcagaagtttgagaccagcctggccaacacggggaaactccgtctctactaaaaatacaaaaattagctgggcatggtggcacgcgtctgtaatcccagctaactgggaggctgaggcaggagaatcacttgaacctgggaagtagaggttgcaatgagccaagatcgcgccactgcactccagcctgggcgacaagagcaagactgtgtctccagaagaaaaaaagaaaagaaaagaaagaaagaaaatttaaaatgatagaatagatgtggctcatgttacatagctctacttgatagctcaggttgggacgatttgcatgtgtttcatcatttaattctcaaacagccctgtgagatcagcacagtttgttgctgtcacatgtaaacctttaataaatgctggctgcaaaaaacatttgactctgatgaggcctttctcccatcgtgctctcattttcctgcctgtgaaatggaaggactgtcccagatgattttgagtgctcctttgaacttgaccgttctgcagttatatttatttcatgtaaattttccatttcctctgtgtgtcgccctctccatgaggcaggcgttcctgtgaaggacctcctcacacacatcctttcccagtcttcatcgtccacacttacaatgctcaacagcggaggaaaccaaggcacaaagaagtatgtctgggctcgtaacagcccacaaaggacagctccaggaactaacccaaagctgttgaaatataaggctttcgttgttgttgtttgtagagatggggtcttgctatgttgcccaggctggtcttgaactcctgggctcaagagatcctcccacctcgacctcccaaagtactgggattacaggtgtgagtccctgtgtccagccaggcctgcctttttaaccacagcagtctcggaaagattccagaagaaatcatggggttcctatctcaatagcgccccctggagttctgcaatgtgcagtacagctaaacccccacgccatgtcactcaacatgttagatgagccttggaggaatagaggggtccggtgtgactctgcaggacctttcccactcccaagctctgcagctctgctcttcatgctgtcgcctccaggaacctcatcctccacatccagctcagaacccagctccagatcaaactttgagcacagaaatgaaaacaaatcaggccagccaggctcaacattcatgcctctgccctgcctatctcacactcgagcctctgctgctctgcctagccttacctcctgctctgaaaatgtgccaagatcgattagtcatgtctgccctgggcttggcaacaaacatgcagacatgagtgtttcatacctgccatctggggcctcctgaatgagacagtcctacacggattaatgcaatactttatcatagaggctgataagttaaaagggctgtattctatccacctgcagtgtgaaaagtgcacctgaacatgtaaatcctcctttaatgtcagaaggtagtattattatgctttgtccatggctttgtgtagcaaagaaagatacttggtgttttcccctgcttcctggtgcagagttcctaaaacccttggaattttcttttttagaaaaaaaaaattttttttttgagacagggtctctctgtcacccaggctggtgtgcagtggtgtgattgtagctcaatgcagcctcagcctcccaggctaaagcaatcctcctgcctcaacttcctgagtagctgggaccataggcatgcaccaccacgcctggctaattttttcactttttgtagagatggggtcttgctatgttgccccgcctgggtctcaaactcctagactcaagcgatcttcctgcctcagcctcccaaagttctgggattacaggcgtgagccaccacacctggcccatcttttgtaatacaccagcaattgtaagtaaagtgtgttcctgagttctgtgagctattccagtaaattattgaacatgaggcggaagctgtgggaaaccccaaactattgccagtcggtcagaagcaccagcggctaggtaattgcaactcgtgtctgaagtgggagcagttttttgggactgagcccctttcacctgtggaatctgatgtgaactccaggtagccagcgtcagaattgctcagaattgtaggacacccagctagtaccagagagctcgagaagcagcgttggaaaaaaccacacacatttggtgtcaggaggaaaaaaataatcccatttatgtgtcagaaagcaatctgaaacatgagtgatgcttaccaagtggatccagagacccctgcgaggtacgtgacggcatccaacaggccctgttctttcatctcactcaggaccccaaggcaggcaatgtgagcccgcagtcctccgcctgagcccagcacagcaacaactggggcctaggcattggggagaaaatcgatcagaggtttagagcctgaggatggaggtgggaacaagaagaagggtacctggggccgggcaccgtggctcacgcctgtaatcccagcacattgggaggccgaggcaggtggatcacttgaggtcaggagttcaagaccaacctggtcaatgtggtaaaaccccatctctactaaaaatacaaaaattagctgggtgtggtggcacacacctgtaatcccagctgctcagcaggctgatgcaggggaatagcttgaacctgggaggtggaggttgcagtgagccaagatcatgccactgcattccagcctgggtgacagagcgagacgttgtctcaaaaaaaaaaaaaaaaaaaaaagaaagaaaagaaaagaaaaagaaaggaggaggaggagaaggaggagacctaggatctcccttaggcaggggcaatgcctgtcccatagaagttcatatccttctatttctatcccatagaagttcatatccttcggtccagctctccctggctgagttgggccctggacactgggcacagagggggcgattctgggatctctggggccaccctcctcccctcacttacctcatcagcctcaatccttagcttcttcagagctttcagcacatgaagtcttcgtctctccacggccgccttttcttctttctggagcccaggaattatggaaacttcagagcttcccaggagaaaacacaaagaagtccagaaaattcacagggaaaagggataaaacacagaatttgacctagaactgggctgtccaagcaggtagccaccagcccacgggtacatggtttccttttggggtgaggaaaatattctgaaactagatagaggtgatggttgtacaacactgtgaatgcattgaatgccagtcaattattcacttttcaaaatggttaattttggggccagacgcggtggctcacacctgtaatcccagcactttgggagggtgaggtgggtggatcacttgagcccaggagttcaagaccagcctggccaacatggtgacatacctccctccctccctccctccctccccttccctcccctccctccctccctcccttccttccatccttccttccttcctccttccttccttccctccttctttccctccctccctccctccctccctccctccctccctccctccctccctccctccctcccttctttctttctttctttctttctttctttctttctttctttctttctctttctctctctcttttttgagacagagtctcgctctgttgcccaggctggagtgcagtggcgcaatctcagttcactgcaacctccacctccccggttcaacaataagacagggtcttgctctgttgcccaccaccagtgcggtggtgcaatcatagcttactgcagccttgaacaccgggactcaagtgatcctcatgtctcagcctcctaagtagcttggactacaggtgtgtaccactatgcttggctaatttttaaaaatattttcttttattgtagagatagggtttcaccatgttgcccaggctagtctcgaactctggggctcaagagatcttcttgcctcggccaccaaaagtgctggggttacaggcatgggccaccatgcccaaccttcagctctttccatctatctccaccaagcgagaggaactgtcacagccctcacctcttgacactcactatgcattccattacacaaatgctctgcttccccatagtggtcagctctaagaggacttaccttcccatggtgcactgcggtcagaaaattctcagtcctcctgccaaagaaatggctcttcttagtcctgtgcccactgttgggcttagcaaagacagtgggggagggctgggactgtcacgggctcatgggttctccttgtccactgcccagacaaaaccaatgcgaacagcaggtgttgcagcaaagagagagagtttaataatctcaggggcggccaagcgaggagaatgggagaaatatttcaagcgcgtctctctgaaaatttggaggctagggtttttcctcgctctttctctttctctgcctctgtctctgtctctgtctgtctctctctctttagatgaagtttccctcttgttgaccaggctggagtgcattggcatgatctcggctcactgcatcctccgcctcccgggttcaagcgattctcctgcctcagcctcctgagtatctgggattacaggcatgcaccaccatgcccggctaatttttgtatttttagtagagatggggtttctccatgttggccaggctgggcttgaactcccgacctcaggtgatccacccgccttggcctcccaaagtgctgggattacaggcacgagccaccgcgtccgacctgagactagggttttttaaggaaactttggtgggcaaggggctgagggaacaattgatcggctatggatgaaatcacaggtgtgtccaaaactatctttgtatagctgagtcagttcctgggagcgggtctcaggaccaggtggtagctcttggtctgccaaaatgctcactctgaaaactatctcaaagacaatttcttttttttaaaacaaaaacaaaacgaaacattattgccaggagcagtggctcatgcctgtaatcccagcactttgggaggccgaggcagtcagatcacttgaggtcaagagtgaccagaagacaagtgtgagccctctgtcatgcccgaatagggccactagagggccccttggtcttggggtaacgccagcgtctgggaagatgcccattgcctagcggaccttggtctagcggttgcgtcagtgcctagagaccaggaaagggagtctccctttccccgggggagttagggaagactctgctccaccgcctcctgtggagggcctgagtgatgtcaggcccgcccgcagttatccagaggcctgaccatctccctgtgatgctgtgcttcagtggtcacactcctgtttcactttcctgttccactctgtatacctggctgcaccctctagatagcagtagcagaattagtgaaagtattaaaatattaaagtctttgatctttctgaaaagaacataaaagaaataatgacataagctatcctctctctctacgccttggctacctaacatagaagggctccctgtccagtggacacgtgactcacatgaccttatcaatcattggagatgactcacactccttactctgccccttattatccaataaataacagcgcagccaggcatttggggccactatcggtctctgcgtcttggtggtagtggtcccccaggcccagctgtcttttcttctatctctttgtcttgtgtttttatttctacgatctctcgtctccgcacatggggagaaagacccacagaccctgcagggctggtccctacagtggcgcaatcatagctcactgcagcctccaactcttgggctcaagcaatcctcctgccttggcctcctgggttgctgggactacaggcatgcaccaccacgtctggcaaagttttaatttttttgtagagattgaggtctcactatgttgcccaggctggtctcattctcccgggctcatgcaatcctcctgcctcagcctcccaagaagtggggattacaggtgttagctaccacaccccactaaaaagctgagttctgtgtttcacgacagtgatattatttatagaagtagctggggaagttataaatcatgcgacccctggttacgtgactctggagcacatatagaaaaggaagctaagggatggcaggtcattcttcaacccacgactgttctttagcaaagttccagcaccttcatgattctaaccttgtcttatgaatgtgacttcaggccaggcacagtggctcatggctgtaatcccagcaccttaagaggccgaggtgggaggatcacttgaggtcaggagttggagaccagcctggccaacatggtgaaaccttatctctactaaaagtacaaaagtcacctgggcatgatggcgggcgcctgtaatcccagctactcaggaggctgagggaggagaatcacttgaactcaggaggtggaggtgccagtgagcagagatcatgccattgcactccagtctgggcaacaagagtgaaactctgtctcaaaactaaataaataaataaaaagtaaatgaatgtggcttcaatctctcaacaaggactgggggtcagttttctttgtctcaaagtttaactatgaattaaattcctctcatggtaattttggcctctgcactagaataagaaaaaaaaatctagcctgtgaggttagaaacaagatggtcagtcatgttagctttctctcattacttacatttctgcgaaggcagtttcaagaccccccttatgaaattaatcagcttccccccaccacctccaaattcatatgttggacttgtaacccccagaacctcagaatgtgactgtatttggacataggattctttttcgttgtttgctttttgagacagggtcttgctttgtcacccaggctggagtgcagtggtgtgatcgtggctcactgcagcctcagcctcctgggctcaagcgagcctctcacctcagcctcccgagtagctggaagtgcaggtacatgctaccatctccagctaaattttttatgttttgtagagatcaggtcttgttatgtcacccaggctggtcttgaactcctaggctcaagagagctttccaccttggcttcccaaaacgctgggattataggcatgagtcatcgcactcggccagacataggctcttaaaggggtgactaagttaaagtggggtcctgagggtggcctggaatttggtttgattggtttattttattttatttttttttgagatggagtctcgctttgtgccctaggctggagtgcagtggcgcagtctcggctcactgcaagctccgccttccgggctcacgccattctcctgcctcagcctccggagtagctgggactacaggcgcccgccaccacgcccagctaattttttgtatttttagttgagacggggtttcactgtgttagccaggatgatctcgatctcctgacctcaggatccgcccgcctcgtcttcccaaagggctgggattacaggcgtgagccaccgcgcccagcctgattggttttataaggagagattagggcctctgcaagaggcttcaggagaaaccaaccctgccaacaccttgatcttggacttctagcttccagaagtgttagaaaataaattcctagccgggcgcggtggctcacgcctgtaatcccagcactttggaaggccgagtggggtggatcacgagttcaggagtttgagaccagcctggccaacatggtgaaaccccatctctactaaaaatacaaaaattagccgggtgtggtggtgtgcgcctgtaatcccagctactcgggaggttgaggcaggagaatcgcttgaaccccggaggcggagcttgccgtgagccgagatcgcgtcactgcactccagcctaggcgacagagcgagatgctgtctcaaaaaaaaataaataaataaataaaataaaataaaataaaaaagaaaaagaaatcctgttatttaattgcacccaatccctggtacttggttatggccgccccagcgggatgaaacagccctccctgcccccacggcttgcctgagcctgggtctggggcgtgtgcgcatgcgcggtggagcttgtgctccggaatccggtgcggaggcttgggctccctgcgcttagcggtgtagtcgctggacagctccttcagccggaatctccgcgggtgaagactgcggggatcctcggtgccaaagcttctgtggtcctcctgctttccttttccccctgtgggaggaggtcgcgggctggaggtgtttcctcctggtcctgagcagggccaacctggaggtaaaatggcccctgcgcctttaaacagccctcctcggcttgtaggccctgcttggttgctccagctttttcagctgttccagagctcacccggagctattttcatccgtg

SEQ ID NO: 136 - DNA, 63010 bp, Homo sapiens; identical to SEQ ID NO: 135

SEQ ID NO: 137 - DNA, 63010 bp, Homo sapiens; identical to SEQ ID NO: 135

SEQ ID NO: 138 - DNA, 186225 bp, Homo sapiens
ttccagttacagctatatcagagaatgagttaatctcctcagaaatcactaaatactactctgaggggcttagaaattaacagggtaagttgaatatcatcttaaatactatctggatttttatagtgaattcctaatttgggcctatagtgtgtcaggcaacagttgggcactgggaagaaaattccttctcttattttccatgcctgtagtggttttcagttttcttttggatcagggcccctttgagagtctgcttaaagctgtgtagatcttttcacaaacattcacacatgttcagtcagagtttgaagatcttcgaaaacttcctaaagttcacagaccattgggcaaccctgtgctttgcagtatttcagacgtttttacaggctttgtttctcttttaaatattacaactctatgaattagtgactgatattgatattttacattgaagaaaccggtgttcaaaatggtatgtgacttttcctgtaatgcagctgtcaaatgtgaggctagaattgaagactttcccaaattttaataatactgttggctttttttaaggttctttcttcttaatatgtcaaattgctccttagtaagattgtgtcagcctttcctcattgtcagcaagtgagcatgcctgcttcaccacattatcccattgggtgttcccccaccctagtgtttgctaaattggcatgtagataattgcatttcattttaatttgtttctttgttgtatttagagttctctatccacttatccattggagtcttaccaatttttgtagcattatatatgaattttgaatatattaagaatatttgtcatgttttgtgcaaatacatttaccctttctgtttgcctttttactttgtgattttttttatgtatagaagttttgaaatgtttaagtattcagatctactttttcctctacattttttctctttttttagtgtagaaatttccaaatgcttcatacatctcaatgaatgcagacacattcacagattttttttttaacataatggcaatctaaaagattaaaaaaggaatgccacttaagttacagatttttgacttccttttgtcatatgtttattggctattggtctttcgtcttctttaaatatttttaagtatttaatctttcataatttttataaatgatatgtagaaatctagattattagttctgatagcatttagtaaatgtttcatttttaccaagatttcaaagtatagtttacccaatgtaagattttcatatacacgtatatttctttgtctctattaatgttcctttgatctaattatctgtcacagcataattatgatgtatttttaatgttattgtagctttaaagtcctcttttattagtttttcaaaactgttttattctttgatatttttccaaattaacttgagaatatattcatcaaattaaaaagtaaacatatgaaggatttttaattacgattgcattgagttaaagattcatttggggccaggggcggtggctcacgcctgtaatcccatcactttgggaggctgaggcgggtggatcacctgagctcaggagttggagaccagcctgggcaacatggaaaaaacccgcctctactaaaaatacaaaacattagctgggcgtggtggcgggctcctgtagtcccagctactcagggggctgaggcaggagaatggtgtgaacccaggaggcggagcttgcaaagagccgatatcgtgccactgcacttcagcctgggcgacagagcaagactcggtctcaaaaaaaaaaaaaaaaaaaaaaaaaaattagctgggccggtgatgtgcgcctgtggtcccagctacttgggtggctgaggtgtgagaattgcttgaggctttttgtttgtttgtttgtttgtttgtttaagacaaaaatcttcctctcttgctcaggctggagtgcagtggcatgatctgggctcactgcagcatctacccatcaggctcaagggattctcccagctcagccttcctagcagctgggaccgcaggtgcacagtggcacaatctcagctcactgcaacttctgcctccatagctcttccacctcagccccagagtatgcccagctaatttttgttttttgtttttgtttttgtatagacagggtttcaccacattgccaaggctgctctcaaactctaggctcaggcagtctgcctgccttggcctcccaaagtgttgggattacaggcgtgagccaccatgcctggccagcttgctatacttctttatgttttttctacacatatgcaacttggaattagatctctgtcctctcagagactttccttatgctgtctggctcccaggagcctcttttcctagtcctttcactagtggcaggggttattctttctcttagagtcttagtgtcaccctcccccactgttttgccccagagaaatacatagtgaagattcttcccatattcttcctactaccctggaccctttcccgtttctcaggacagaaggacaggtttctcttaggctttcagatgtgctgcctcagtagtgcagcttcataacagactggctttgaggcagagtcagcagagaagaaaaaaaaaaaaaagaaactgggaactcccctcgtactgctccaaaccacacactgtagcccacagatgcttgttttacacccactagaaagagggggtttctcctggagttttgccatgtgtgtctgctgcctaattctgggactctgcccaccctcaggtcaaagtggtagataaaggaaggattaaaaaaaaatagtaaactcaccttcatattggttattcttcatattttgactttcttctccaacgcacctgacattgttatttttcagttttcaagaggttgcttttagtattctgcccagagtttttagttgtaattagtgagggagataggctgtaaagggcttattccatcttgacattcactgaaagtcacattatttcattttaaaaataatttttgttttgattttcccaaaattcttcttgttccttgactattataagaacagatttttgttgttgttgttctgtgcatatactggcctcttgtatctctctcaagataccaataaagttaggaacattttatttatttttgttgccttactgtattttctttgggtcattgtgtctctacttctacactttattgcctctcttggtttttattaagtggccagtgattgttagctttcttctttacagtattttcaagtaaaggtcacaatcagtggttgtcttacttgaatgtatatacccattgcttggcggcccaggtaaaatgtagattcctggtcccatggacaaaaatctgattcagtaagtctagagtagggcacataaacaccttaaattcttttgatgctgatagttgaatgatagcccttgaaatcttggaaactggtgtaattctgtacagctcattattcccctttacaaaatactgtcttacccactgagcatcatggctgaccatgggactctgcagttggcttcccgcttgctgtggtgagtgagaggtgggctttccctcccctcccctcccctctttggagacaggatctcattctgtcacccagactggagcacagtagtgtgatcatggctcactgcatccttgaccacccaagatctaggaaactttccacctcagcctcccgagtagctgggactacaggtgctcgccaccatacccattaatttttctgtttttgtagaggtggagtctctgtatgttgcctaggctggtgtggaactcccagcctcaagcaatcctcccacttcagtctcattgggattacaaccgtgagctactgttcctggactcatttttcttatcatgcacttgcagagacaaggctaatagcggggccctgtccctcggtttctgctgttggaaaggaatttttctgcagggagagttctgattagttctgagttgccttcctttttcccccctctccgttgagattgtctttagcctgctattatctccatttcaaagttcacactataagccctcagacaaagactttagactcatgataaatgctgtggctgacacttacttgtctttagagttgtactggccatcattggtgttttttcactcagtcgttttgtggcctgcccacacccccaggcccttctgacctcaggtctttagtaggagaagaggtagatgaatgggctcactctgccatcttaattgaatgtccactgttaatcttaaggtgatattggtttctaatgtgcaaggtatttctgttgaattctcagatataataatcatcatgaaatctgtagtaggatcacaccttatgtatactcaggtgtgcaaagaaaatatagcttctttatttttcttatctcttccttttgatgaaccctggtcactggatggccggaagaagagtaccagacttactcccatctggtaaactgggtcttatccaataatttaaatagttgtgtttggatatttcagcttctggatactactcattcaaatattatctctttcctcagacgtgcccacaacagaatctagacttatgggttggcttgtgtgaccttgtagtggtggaagcacaccaagaccctcaatctatctactgtcttttctggtttcttactggtctctccctggaattgtggccaccgaggtactaccagaactatcgtttgaggtactaccagaactgtctgagacctgttctttttgctcctagaatgcattgtccatctttcctggtgtcacagatagcctgaagtctggcttggccccctgagcctggtattctctcttccaggcctcttgctatggaattactttatccctctggcaaagtcgtcaatctgtatcttaagttacctttcccgtactactttagagcacacagaagtttcctaaggtacatttcctaaatgtaccttcttccatggcacatgagaaataagggagatgccagagctgatctcacattccttctcaatcttcctgtgtttctgtgcatatattttggagtggctatctccagcttctgttgagtaggcatagggagaggaaagaggttggtggtgtgtgtgtgtgtgtgtgtgtgtgtgtgtgtgtatgaaagtgtgtgtgtgtttgtgcgcacacgcgccacgtgtcagggaagttcctggaaggcagtcattttgtacagtcttagtgggaagtgaagctgactgttctagctcccagatttccttactccatcagacattcttttcttctgccccatctgcctgaaagatgatgatgggagtattggtcacttgcatcttctgtctctgtctcaccttttaatcccacaatccttcatccagaatcaggagtttggggctataattcatattttttctaatttatatcatctttctaccctaattgacaggccccatgttctgactgtcatgagcagaagggatatctgctctgtactgtggaagaaactataatcctactcttttcaatcttggccagaaaatattagtgtctaacaaattccttctttgggaaaaccagactttcaaaaacttttatcttagtgtaaaattctttctttaattcataaggtaaatattaactatttctttctcttttcatttttaaactttaccaaatatatggatgctactcatagaataggagggaagtcagtggaaggaaaagcaaatgagaaaagcatgtcagtatcttttcataatcatgagagcatatctactctcagtactcccgtttctcaagacttccttggcttttcttacatttacttttttaattgtagtagagactcttacaagattatgcttctaaaacatattatagttatttgatttgtattaagcttataactttgatatttttaattatagttttctcaaataggaaaatagtgtgtctctattttttcaaatcttctcaaaatatttatcaataaggttttataaaattttgaaatgtggatttaataaatatgtctcacattctttttaggaaattttttttctttttagtttttaagagtaaaatccaggttgcaactcagtttcttctgccttgtagctcttccctgtgtggacccatggcactttgtttatttgtcttttgtagaattcctcatatttgtgtttaccaaactgtagtcagctcaatgcagggaatcagacattgcttgtctttatttgccctagtgcccaacaaattcctgctcatgataggcatggggaaatcagcaattcctgtgctcctttcctgatttattttctccataggacttaccatgttctaacatactgtattgtttatttgttttatttattgtctgtctcttctcactgaattataaatagcatgcaggcagagattttgaacgattttgcttactactgtattcctaacacctagtggagcacctgtcatgaaggtgaccagtatttgttgaatgattaataaattatcaaaatttagataattgtctaaattatatcatatgatctataaaatactgtaagtataaacttctggtataaaaaatagtaatgtaattggaaaggtacattaaaagttaggaagaccttaatatataatctactatcccattttgtgaaatgagcaagaaataatttaagcacaaagcccaagctaattgtggaaatggaccaagaatttagaactcttaagtaaaacataataataatgtcaactggacatgtggtaagcagtatatatggttgtagttaagaaaaagtacaggttctgcaatcagacatttctaggcaagtttcttgatctctctgtgccttagtttcctcccctgcaaactaggaaaaaattgtatctttcttatagattgttctaagacatctatgaaataaagtgtagtaactcttagcacactgcctggcgtttagtgaaggctcaaaaagttagcttccattattactatttggaatatctgccatctgtagcttgtggatgtgagagttctttagtttttggtggggcttttaaaaaatagttcctagaggccaggctatcttttagtctttccttcaatccctctaatatgccaagctccccagttctctgaattgatgcatctactcttctattggcctagagaacactcttctctgacatgctttgcttctttaacacctacttatctttcaggtctcttcctgtttctctcatttttaaatttttattttaagaatttataaatatatacaaaagtagagagtatgatgaatccatcaccatttctatgtatccattacccaccatcaatagctgtggggatttgatctctttaaaaattaaaaaaaagttttcttgaaatcccagtaaataccttttatttttttcttcctagcacattaacacaatttgcaatcatgtatttaatgtctcttttctccattagtttataagctccataaaagctgttttctttattgtgatatatccagtgtctcatacagtgcctgaaacatgataggttctcaaatgtgaaaggaatgaattatttaataactgaaaacgtcgctaaggggtttgaaaagacgagcatttgatgaaaactttttgaaaaagattggtaagaatgacttaggcagctttatattaaaacaataggtaccgttaggctcagattcatatacttattaagcaaccttgtgctcttaatttttttccaagtaagcttctgtgtaaagcaaactcagtgaccttgtgaagagaatattatttgagtttataagatattgtccatagtaaataactaaattagctttgggggatcactcttgggcaaggtaaaatgatcccttgaggtgctgggccttctgggctgagagatcaagcaccttgacggctcatagagaagttatcatcttgaagcctttgcccagccatcaacctactccttgttgctgtagcttcatttgatgaaatttaagaaaagtgtttttctcttcaaattgctatcccctcctaatttttttttttttttttttttttttgatactgttttgaaccagtaaccatggtttcttgtagaggctccttgggagctttaacaacatcagtcagtttcacagctggaagcagagtgatctagataaaagcataataaaaaagcttactgaggtttttttcccccctgttataacaattctttcattagggagcactttgcataaagtgaaatgttctctgttcccactgaagtagacattttaatttaaattaacagtaacgtagtacctggttcctttttagagtctagaaaagggaggtaatactaccattcacctgtccttcacctgaacctaccctgtctctgtccccttctttttttgtttctattttcttaccatctttctgggccaatggtgagtgatagtaatactgacatttggggttcaagatggatgaagtcgtgaagttgtagctttgaattaatgagggaaaaaggagttaagtagcaataaaaacttgatacagtggtaccaggagtttatttgtcaggatcaagaagagtcaaggactggctcttgtcagagggccagagtaagtaatttgttagaagtcagcgttggcagcaagcactgtcttgacggatggcactattgagaagggaaaggaaacctatatttattaaactctttacagaaaagcttgccaaccctcattgagatagactggatcagtctaccctggactggatatgagaatggttatattgtggggaaagcacactcttaggttatactgcttgtggatattagtatagctgtggcataaaaggagcatgatgggaatttggatgagagtagtgggtcttctgggcctttctttatcgaaagtctaaaccctgcctgtgaaaggaaactccaaatgtaaacattgaatgtttatttttttttacacatttctttgtccttcctacatgtatacctatgtccatactctcacatggttttactgtaattctgttattcgtatacttacataaatgtggacttacacaagcatcttaattggaaatgaccttggagatcacgtttcaacatccttattttacaggtggcaaaaactaagtcccttacaagttatatgcctggtgtcacaaaagcaggttagtggcaagttttgggagtaaaaccctggttctttgaattcctgttgtcatgcgtacaggtattcacatatgaagtctgccctataaggcctcacccaatatgtatctttagctttaagtagcctttcttagaaaactaaaacagctgaagagaagagaagcattaaatctagattcttctaacttaactctgctactgattatctttgcaatttttaggaagtgtaccattctttgataaacagaaataaggatccagaagataaattgtaattataaagattactgtggactaagatcctgatatttgcctcatttcctgatccctttcacagtgtaatttatgtgaaggaaatgtacaattattcaagtaaacacggtactagattcacagttcctaagtataataatttataagtggaacattgaagaatccagaattcatgttgctgtaaacatgttacataagcttatttaaatgttttccttttgtgaattcaataaatggtaatttgtaatttataataaaacatacgattatgatttcgtaacttactgaaaaaaactttaagaaaattaggtatcgttcaactgaaaagacaaaaggaatataccagaaattatagccattttattttcatgttcctgatgggggtattgctgtcacaattggggcagagtcattatttttctcaaattcaggattagaaaggtctttgcctttattgcatcagaacataatcacagaatttcttcttgctggttccctggggacactctttagacaagagaaatcctaggagaaatttgcacaaaagatgtacatcagaaactaaactacaagagcagatattagcatgcttttggtttgttgtgcagatggtttataaaatccttaacatcggtattacttgcctacttttaattaacctctaaagaattgtgtaattgttacttctttccttctctatgataagtcagccctctcagctttctttcctgatacagttgaaagcattttaaattttatccttagaaatacaaatactgaacaaattaatgttgtagttcaacatacttaaccaatcttaattataaattaggatgcgatgagactgtttcacttttaaaatacatgattgatgtttaatctttcagaaatttaagctattatagtaatgcaattgcttatacttagttttgtgtttttattaaagtcttatctttaaatggattgtctcattgaagaaaattaaatgggccaaatgtttgtttaacttcggaattctaaataaatatttttcttatagttttattagaattgggattgatatttatgtaataataatggtttgattgtcacttatctggaactctgatttaccagcacagttcaattatctaagttaatatttttcagttcttcaaaaccatgtttctatttgatagttgtaaaatcacctcttcatctttgctattgtctgaaatttaaaataaatataacttgttttttaaaaatcaaaagaatcaggtagaaagtactgctttgttttcaaacttactagcacacctccaatgtattgaattctatttaaatttacaaaacagaagtttcttacatgagtttcatggaccacttcagaggctcattaaatctgatattatatataaagttttatccatgtgggaattcttttgagatgaaatatctgtagctttattggagtcttgacgctttccatcacctaaacaaggttaaaaactatttttataggacctctgaagtatcatactttccaaaagaatatttaaggtaaaattgctttgctttctagaatcacttaattatagaatcttggtgtagccagcctccatttttacagatgccacaagttgtgatttacccaatgatattgtagtttaatctttgtcaaattagcaggggacacaatgaggcgtcctaattggtgtcctaattgtttttggtgtcctaattgttttttagggcctttttagccttgcagcctctgcatagaggttatggagctctcaactaggcaagcaggtattagtatttgaatacaaagcttttatgggcacaatagagatctccgataatttgcctcaattatttcatgaagtgttaatgtgatactgtgtcatctctttgctgtatatggtgtatgttcttacactgtatatggaagcccctgtagttgcagaggaaaatctgtctttgacagcatctgtgttgaggtagactttcaggagtgagatcatgagatttcagactataagaatctcagacctgtgagcatttcatttattcatttaacaaagatttattgtgtgcctgcttatggagatgtaggttttactggttttgggataccaaaagagccccattgtgtcccctgctaatttgacaaggattaaactacagtatcattgggtagatcacaacttgtggcatctgtaaaaatggaggctggctacaccaagattctgtgattaagtgattctagaaagcaaagcaaatttatcttatagaatacttgtggaaaattatagtactgtgttcatttaataatatcggtttggttaatattgggaaatgtttttctgattacttaacctgaagaataaaatgccatacagtaatactgacagcagttcttacaaaatagtccttagcgtagtagtctcacagagttatgaaattctcagactactaggaattaaagaaatctcctaatttaaatataggaccaaagcccaaaaaaaatctttgttttatttaccattttgtactatttgataaagatttgactgtcgggcttaagttagtgattttttaaatgttttaatttagaggttatgtttcacattgtaaacctagatcctgaatttttatatttagtaatataagatggcatacttaacaaatgcaaaggctacaacaaattaattgagagtattcttaaataaacttaaattttaatcatttttgtgtatacttaagatgatttcaaaataaaggttttatgatttaatgtgctattacatttcaaagagttaaagacttacgccattctacaatattcattttaactggtatacttgaggtttatgaactgtgaggttttgtgtgtctttccaatccctgttaatccatttggcttttcaaactggaacaagattcttcaatattctaaatcctattttaagattccttagccagttcagctcatgtaaagaaatcatccaaaaggaatattaacaatgtaatatttatattgtgtttgtttttacacactgtgcttttgtggttttactttatatgcttagggtgtataattggtttccaagggtcaatatgtgatcaacagtgttttacctatgggaagtggggttctattgatataggaacctcaattatacatccttcctctttgttcccatgaatagtatcctgagctcataacctataaccttatgatgtttacatgttattttaattacctcttatctcaactaaatctccctcaaatccttgagaacagagacatcagttaaatcaactttgaatcctcagaatgtagcacacagcagacatgcaaatattttttaaatgaatgaatcaattgtgagacatgagggcttatcttggatcctctatagtcactaaacaggattttaaactggagaatactgtattggccaatggttatctggaaaaccataatcaatgggagtattgtttgtgtttgtggcaggggctggggctggggctggggaagattttcaggaaatggctcagtaattgtaggtgctggagagtctgaaatctgtagagtgggctggcaggctggagacccagggaagagttgatgttacaacttgattctgaaggcagtcctgaggcagaattcctttttccttgggcaacctcagtctttttctcttgaaagccttcagctgattagataaggcctactcatattatgaaagataatctgctttactcacagtttactgatttaaatgtgaatctctttttttttattattatactttaagttctagggcacatgtgcacaacgtgcatgtttgttacatacgtatatatgtgccatattggtgtgctgcacccattaactcgtcatttacattgggtatatctcctaatgctttccctcccatttcccccctccccacaacaggccccggtgtgtgatgttccccttcctgtgtccaagtgttctcattgttcatttcccacctatgagtgagaatatgcagtgtttagttttttgttcttgcgatagtttgctgagaatgatggtttccagcttcatccatgtccctacaaaggacatgaactcatccgtttttatgtctgcatagtattccatggtgaatctcatctaaagaataccttctcccagacagctaagctggtgtttgaccagatatctgggtacaatgccttagttaaattgacacataaaattaaccaattaagtgattaatttcagtgggaagattcagcattctcgtaaatgaaattagctataaaaaattgaaattattataaggaatagtcacaagttataaaagaaacattcattgctatggccaggaatatattgctatattggaatctttaagggcagaatggaaaaaaaatgaaagcatatgaacaattattacataacatataaattaggaaattttaaaggagaaatgatcagaatttaggaaagtattcttaaaggatgtgaattttgataaaaatttgaagaaagtatgcatgctgtgcatatatggagttggcagagaagcctgataagtagagtaccacaggccttatgagaggcttggggaaggaaggacagggagaaactggcaaagagcgttgcatatacattttaaatttgtttagctggagaattaaaaaaacaaaaacaaaaaacttctaggagttaattaggaaggaagagattaaatgaaaacatttcttttacatttttcttttttttaattttaagacattattttagattcaaggggcacatgtgcagttttgttacatgggtatattgcataactctggggtttgggcttctattgaactcatcgttcaaataatcaagatactacccaactggtagttaaaaaaaaaatttcttaaagatctagttttacatgtatgatggactagagtggttgctaagcccaagtacaggagatgaggacctggacaaagatttataaatagaaacaaaatccaaatagagaattgagacttctcagagactgctgagagaattgacagaactttgtgatttaatgttggagacaacacaagagaggatatactgattttgcctaaattgtcaatctagtattgtaagaatgatgttgttaattttgacagtgatgtggaaatttaccaagatgggcaagtggaatataaggaatgatgtacacatgtgactcagatattctgtggggcgaaagtggttttatcattgtattccaatatactggacattctgagacacaaaatatggtatcttcctattaagggatgttattctactaggggaaactggcatacttttattataaacttcatagtataacatataatatttgaagatatcagatatatcacataaatggtaaatcatctctctcagtatagtcagtgtctactgtgacaaagcaacaaaaactgtagcagtttaaagtgggaaggtatttacatgtattttctgcgaaggatttatgagtgtctcagattgaggcccttatacgtaggatttttaaaaactttatttacacagtgggacaaatagggaagcaggaagccccataagttggaggcttagctatgacttaaatatactacatgtttttttccctaaactattaatttggaatatcttgtaacttatatacagcccttctactattttattatgtatgattgatctttttttttttttttttttgagaccgagtctcactcttttgcccatgctggagtgcaatggcatacatgaccttggctcactgcaaacctctgcctcctgttttaagcgattctcgtgcctcagcctcccgagtagctgggattacaggtgcccgccaccacgtccggcaaatttttgtatttttagtagagatggggtttcaccatgttggccaggttggtctcgaactcctgacctcaggtgatccacccgcctccgcctcccaaactgctgggattgcaggcgtgagcccagccgattaatcatttttatatgcctaagccttagtcctattatataaatcagagccctgtagcttcacttttataaaatccttttattgcatattccccattcccttctttagtctatcagtctcagaagttcgtcaaagtattgggcatttcttgggagcagcattgcgattatgtttttttgttgttgttgttgtttttgaggcagggtctggctctgtcgcccaggctggagtgcagtggtggtgcaatgttggctcactgcaacctctgcctccctggcccaagccatcctactgcctcagtctcttgagtagctgagactacaggcatgtgccaccacgccctgctaattttttgtattttttgtagagatggggtcttgccatgttgtccaggctggtctcaaactcctgagctcaagtgatccgcacgccttggcctcccaaagtgctgggattacaggcttgagccaccacacctgtctgcattgaaattattatgttttttatttcccattcgttgttattttgttgttacttatactgtgtatgcctttgctttcattatttgcacatagtcctgacaatggcattaattgggatattccttgggccagagatacatattcttactattgtcactgtgcttgagcctacatcctcttgctttctttccagataggaatttctttcggtgatagtatttattcctgtgcttgtttctcaagccctattctaatttccatcctccaaaccttattgcctcttactattattactctcatagtaaatatcttctttggattgcattcatagcaatttatatgatacgcatagaatgtgaattactgaaataaaactattctgttcacctcaatattctgtacctcagttttcgttaagtcaaactgattttctctgcaagtagtttgtgttttcagtgtttcagtacatgttattatcttacagtatggaaatattatctagtagtgtaaagatttgtcacataaaattactagaaaaatagaatgtttaaaatatgcatgcaatttacatgggaagctttacacagttctatagttttagtgttttttttttaaatgctgttcatttataagagttaatgagtcagtgaaactacatttttaataataccaggaggaaaggatttaatagatctttaacatcttctgttttttttgtttgtttttgatagaacctcactctgtcacccaggctagagtacagtggtacaatcagagctcactttaacttccaactcctgggctcaagcgatcttcccacttcagctttccaaatagctggcactacaaatatgtaccaccattcccagctaagtttttaaaaaaatttttagagatggcatctcactatgttgaccaagctggtctcgaactcctggctgcaagctgtcctttcacctctgcctcccaaagtgctgggattacagccatgagccactgcatctggtcagatccataacaccttaatgccacatctttttctgacagttttattgattgggattactctagagatcattctttggaaaacagctcctccttcctccttttttttttttttgttttctttctttcttctttttttgagatggagtctcgctctgtcgcccaggctagagtacagtggcgtgatctcagctcactgtaacctccgcctcctgggttcaagcaattctcctgcctcagccttctgagtggctgggattacaggcacacaccaccacacccggctaatttgtttttgtattttagtagagacagggtttcaccgtgttgcccaggctggtcgtaaactcctgagctcaggcagtccacctcccttggcctcccaaagtgctgggataacaggcgtgaaccactgcgcccagccacttcgtcctttctttaccggaagtcagaatacaagaattccttccttatcaggtagtttaatctttgttagaattattatgccttcaccgtttaattttttcttgttacttcttctgtcgtttcaaaaaatactcattataattaaaatttaggaagaaccctggaacttaatgtagctgtcagagagattaactacaatttgctgacaagtcatgtgattggggaagaatagcaacaagtaattggattgttaagtagtaaagtttagcaagtttaaagtaaaggcagggtctcagtttgtctcccaggctggaatgcagtggcgtaatctcaggtcactgcagcctcgacctcccaggcccaagcagttctcccacctcagcctccccagtagctgggactacaggggtgcaccaccacaccgggctaatattttaattttttgtagatatggggtctcaccatgttgcccaggctggtctcaaactcctaagctcaagcaatctgcctacctcagcctgcctaagtgctgggattacgggcatgtgccactgcgcctggcaacagtaaggttttaaaaaatacactctaagttattttccaaatttacgtagtaactagcactttcttgaatatttctttaggtaatcaagacaataaatatattttggctaataaataagtaaggttaaattaaaaatttaagttatttttaaataaaataaatattatttaaataaaacgttttaaataaaatattctccaatttctttaatcattttataaaaatttgttatcctccatataaaagtagatataaaaacattgtttagtatgttaatgtgaactaagcagtgtcatgtacatcagcctcagaaatggaattttaccaatactgtggaaactccctgtgtaagcctgtctcaacttattcctcttcctgcactgttccccagtgtgtgaacactatgctgaattttgactgttatgctcttgatttttaaaaaggttttactgcgtatgtatctattcctaaattatctattgatccacttattttatcaaactttttaaaaaagataagacgtacctacaagatattgtgggttcagttccagactaccacaataaagcaaatattgctataaagtgaatcacacaaattttttgcttccccagtgcttataaaagttacgtttatgctataccgtagtctatcaagtgtgcaatagcattgtgtctaaaaaaatatatataccttaattaaaacatactttattgctgaaaattgctaacgattatgtgaactttcagtgagtcataatctttttgctggtagagggtcttacctcaatgttgatggttgctgactaatcaggatggtggttgctgaagattggaatgcttgtggcaatttcttcaaataagacagtgaagtttgctgcattgattgactcttcctttcacaaaagatttctctgtaacgtgatgctatttgataacattttttacccacagtatatcttctttcaaaattggagttaatctcaaactcagccactgctttaccaagtttatgtaatattctaaatcctttgttgtcatttcaccaatgttcacacagtatcttcaccagaagtaggtaacatctttaaaaaccactttctttgcttattcataagaagcatctccttatccattaatgttttatcatgagattgcagcaatttagtcacttttcaggctccatttcgaattctggttctcttgctgtttttaccatatctgcggttacttctactggtcttgaactcataaaagtcatccatgatggttggaaccaatctattccaggctcctgttaatgttgatatttgatctcccatgaatcacgaatgttcttaatggcatccagtatgatgaagcctttctagaaggtttttagttactttgcccagatccatcagaggaattactatttatggcagttatagccttatataatatatttcttaaataataagatttgatagttaaaattactcattgatccatgggctgcagagtggatgttatgctagcaggcaggaaaacacattaatctccttgtacatctccatcagagttcttgggtggccaggtgcattgtgaatgagcagtaatattttgaaaggaatctttttttctgagcagtaggtcttaacattgggcttaaaatattcattaaactatgctgtaaacagatgtgctgtcatctaggatttgttgttatagcacacaggccaggtaaattaaacgtaattcttattggccataggatttttggaatagtcactgtgcactgtctttaccttcaagtcaccagctgcattagcccctaataagagttgagttagcctgtcctctgaagctttgaagctgggtgttggtgtctcctctctaactatgaaagtcctgaatggcatcttcttccaatagaaggctgtttcatctacattgaaatctgctgtttagtgtggccactttcatcatagttagatcttctggataacttgctgcagtatgtccatcagcacttgctgcttcaccttgcacttttatgttatggagacagcttctttaaccatcatgaaccaatctctgttagcttcaaacttctgcagcttcttcatctcgctgtcttcatagaattgaagatagttgggggtcttgttctggattagtttttggcataaggaaatgctgtagctggtttgatctatccagaccactcaaactttacccatatgagcaacaaggaggctgttttgctatcttatcatttgtgtgttcgctggagtagcactttaaatttccttcaagaacttttcttttgcactcacaacttggctgactggtgtaagaggcctagttccagccggtcttggcttttgacatgcctttttctctaagcttaatcatttctagcttttgatttaaagtgagagacatgtgactctttcacttgaacagttaaaggctattgtagggttattaattgacctaattttagtattatcgtgtctcaggtaatagggagatggctggtttggtggaacagttagaacatacacatttgttgattaagttcgctgccttatgtgggcttacatgttcatggtgccccaaaacaattacagtaataaaatcaaagatcactgattacagatcaccataagagagataataataatgaaaaagtttgagatattgtgaggttttccaaaatgtgacacagaggcacaaagtgaacacatgcttttggaaaaatggcaccgacagacttgcttggatcagggttgccacaaaccttcaatttgtaaaaaacacaatatctgcaaagcacaataagtcaaagtgcaataaaaggaggtatgcctgtatattgtatgtattctactatctacctcttaagtttttaaaaatttttaagatttatttatgttgctctgtagaacatttattttcctgggtttatactattcagttaagggtatgtgacagtttgttctattgttgattgatacattgtttttttctactatgaacaattgagctatgagtattcttattttgtggtatgcatgtgcaaaagtatcccttcctagaagtagaattgctgagttatggggtttgtgcatattcaatttcagataatgccaaattattttccattttggtttgtggcagagggtggctagatatacactgaaaatttcctcttcttcctgggcacagagttaggttgaattttccacctctgttgcatcaggaatggccatgtaaatgaattctagtcagtagaatgtgagtagaagtaatctatgccacttttaggcctggcccacaaaaatctgccatgcatcatcattcagtttctcttctcccatcttttggccaagttttgtttctttcataccaattcctgtaccttttcctacctgttactgtgctggctagacttgtacagcgttgtatagaagtggggattaatgagtgttatttctaattttaaagagcgtgcttcttatatttcacagatatctacagtacattctgtgttctctagattacctttatgaagcaaggaggttctctttaagattttttttaaaaaaatttatcgggaatgctgaatttaatctgatgttttaccagtaatgattgagatgaacatttgggatttctcttttgtttccttaatcttgtgaatgatatttataccttcataatttttatttttttatttttatcattattgttattattattattttggtgacagagtctcactccgttgccaaggctggagtgcagtggtgcaatctcagctcactgcaacctccacctcttgggtttgagagattctcctgtctcagcctcccaggtagctgggattacaggcgcctgccaccatgcccagctaatttttgtatttttagtagggacagagtttcaccatgttggccaggctggtctcgaactcctgacctcaggtcatccacccgcctcagcctcccaaagtgttgggattacaggcatgagtcaccatgcttggccttataccttcataatgttaaactgcacttatatttctagcataaactcagcttggtcatgagatatattaatcttttgttcatcactttcttcagtttgaagtattttttgctgtctccatattttcagtcttagtttggatagtgagaaataccatgttatatgagtatttcagatactcccaaactttccagttcatggtgtcctcaagtcaaagaaatacctaacagctacgtttatttagtttcaaacaagttagtatttatgtccttataacttattagttatttgaaaaaatcatatgcataaattcgatatatttttattttaattgtaaataaccacagtcccttgctaatgggatatgtgtgcacctcagagcaatgcataacttctcaaaccttggaatcagataaggcattgccattgccaccctcacttcttgttccatgttgattttcacttggggatgctctttttcacagcaactaccataaactcagatttataaggataacacatcattgaaaggaaagtggtactatttaattttgaaattatttggtgtcagacagatgttgtatagcataatttgggaaaccctgaattttggagagtgaatagttagaatgtgaacagtgaggggtactgtgttttttttttttttgagtctatttgatatttatattttattaagataagttggaataacaggatatcagctatatctttaataaaatttgctatagtcattttctgtgttgagtttttaattatgagggatacttgtgttttatgtactgttttgcatctatgatcaagagtgagattggctgggcggttttgcatctatgatcaagagtgagattggctgggcgcacggtggctcacacctgtcatcccagcactttgggaggccaaggcgggcggatcatgaggtcaggagatcaagaccatcctggctaacacggggaaaccccatctctactaaaaatacaaaaaatttagccgggtgtagtggcgggtgcctgtagtcccagctactccggaggctgagacaggagaatggcgtgaacccagggggtggagattgcagtgagccaaaatagtgctactgcactccagcctggatgacagagcgagactcttgtctaaaaaaaaaaaaagtgagattcacctactttagtttcttacactatttggttttggtattaaggttatactggcttcataaaacgagttggggaatgaatattttctctttcttgaagagtttacataagactgaaattgttctttgagtttggtaaaactcaactttctttgtgagattttaaaaaattattatggttgaattcgtttttctttttgcctacctgtattttcttatttactgtaataccatacaatacacttttaaggctggacaatcttataccaagaacacaaaacaaagcctgtttggagttgattctaagtaggtttatcgcttagtcaccaaatcttgtacttttaagcaaaactaactcatagttttagagaagattttaaactgttgatttagtttccttcatgactataggattatttagtcttttcatgtctttttgtgtcatctttcaaaaaacttttttagcaataattttagatttacagaagagttgtaagaatagtatattgaattcccatatactcctcacccagttcccctattattattattattattattattattattattattattattattattattttgagacagtcttgctctgtctcccaggctggagtgcagtggtgcgatctctgctcactgcaatctccgcctcctgggttcaagcaattctcctgcctcagcctcctaagtagctgggactacaagcacgtgctaattttttgtatttttagtagagatggggtttcaccctgttagccagcatggcctctatctcttgaccttgtgatctgtccacctcgtcctcccaaagtactgggattataggcatgagccaccatgcctggccagttctcccattattaacatttgcattaccatggtacatttgtcaaaactaagagactgacactggctcactgaacttgacaccttatttagatttcaacaggtttttttgttttgtttttttcttgttgttgttgtgttttttttttttttttttcatttatatcctatatcctctttctgtccagggttcccacagtatcacattgtatttaattgtcatgtcttcccagtctcctctggtctatgacactttctggttttccttatttttgtgaccttgacagtcttgaggagtactggccagatattctctctgttggggtttgtctgatgtttttcttgtgaggttgtgggaagactaccatagagaggaaaggcccttctcatcacatcattttagggggcacataatatccatgacatcactgatggtgttaaattaacctccatcacttggtaaaatagtgattgccatgttactcactgtaaagtcattattttttcttttccttacttaattgttgtttgaaagcaagttactaaatcaccttcaaggggtgaggacatgggaattaagtttcacctcccagagggaggagtagctacataaattatttggaattcttctgtaagaaagatttgtttcttgttctccatttaaaatatttatttaaccatatgtttatatcactgtgtcctaggttagttttagtgggttatgtatctttttaattgaatttactggttacatttgttttcaaatctattacttaaatgttttcaacaaaaacattgatctttgctttgtcagttgttaagttctccctttcatttataattaccttgtattattttctttcttgatctcattggcaggatttttaaaagtcatttcaaagaaccaggctgggtgtggtggagcagggccatcccagcaactctggaggctgagactaggaggattgttggagcccaggagttaaaaggctgcagtgtgctatgatcatgcttgtgaatagccactgcacctccagcctgggtaacatagcgagacctcatctcttaaaaaataaaaaaggaccaacttttggtttaattattctctttattgtgcatttgatttctgtttcatcaatttgtgcttttatatttgtgccttttttttttcttggtgaggaaattctttctggtaacttcttagacatttagctcagttttcagtcattcttttctaatgaaagcattgatgggaatacattctctgagtattgcttttactacattttatgattttgaaatgtagcgttttcattattttttcattcttgggtttaaaaatatttataattttttccttgagtcatatgttatttagtgatacggttttaagttttgaaatgtatgacaattttatgtctttttcttattggctttgatttcattgcattgtgatcagggaatgtagtctttctggtagtaattgttccattttctctaccatgtcttttaacctttctttcatattttgcatttctttgtgactataggctgcattcttttttttttttttttttttttgagacagagtctctgtcgctcaggctggagtgcagtggcgtgatctctgctcactgcaacctccatcttccggttcaagcgattctcctgcctcagcctcccgaatagctaggactacaggcacttgccaccacgcccagctaattttttgtattttttctttttttcttttttttagtagagacagggttttaccgtgttagccaggatggtcttgatcttctgacctcgtaatctgcccaccttggcctcccaaagtgctgggattataggtgtgagccacagcgcccagcctttacgctgcattctgaattgttttgtcatttctgtgtaacagttcactgactctgtttatttacttcttccattatgattttacttgtgatgtttttcaattctagtagttctgtttggttatttttcagatttgcccattcattttttatattctctcgagctttactagtatttttatttgttccatctttttctcttaatatattaaacatatttaatattctatatttgataattctaatatctgaaattttacaacaaattttgttgtttgttttctctggctctttctaatagtgccttatttacttgtatttattgtggttttttttttttgaatcatgaacttcttttttttaactggaaccctgtgtaactgtggaactctttagacttgagttcacagtgcattcctccagggaagattttttatttccttctactatgtgcttggagttaggggtctatgaacataggttttaacttgaaattctccccttttaaaaaattttttaacttttattttagattcagggagtacatgtacaggtttgttacatgggtatattgtgtgatgctgaggtttggggtgtgaatgaccctgtcacccaggtagtgagcatagtacccaacagttaattttttaacccttgctcccatctctccctccctgctctgttagtcccagtgtctattgttgccatctttatgtccatgagtgcccagtgtttagttcccactcataaatgagaacatgcagtatttggttttctgttcccttgttaatttgcttagaataatggcctacatccacgttgtcgcaagtggcatgattttattttcttttacagctgcataatatttcgtggtatacgtgtaccacatttaatttgtctgatctactgttgggcatctaggttgacttcatgtttttgctattgtaaagagtgctgcagtgaacgtaagagtacatgtgtctttttggcataacaatttatattcttttggatatgtacctagtattgagtttgctgggccaaatggtagttctgttgtaagttatttgagaaacctccataccgtttcccatagtgggtgaagtaatttacattcccactaaaaatgtataagcattcccttttttgttttatgaagttggtgctccagtgggtttatatttaggatagttaagtctttttgttgaattgaaccctttattgtaatgtaatgtccttctttgttctttttttactgttattttaaagtctgttttatatgatgtaagacttgcaacccctgctcctttttatttttcatttacatgatagatctttctccaaccctttactttgagcccgtgggtattgttatgtgcgggatgggtctcttgaaggcaacagatagatgagtcttttttttttaatccaattcatctctgtgccttttaagtggggcatttaaaccgtttacattcacagttaatattgatatgtgaggttttgatcctattgtgaagttgttagctagtcactgtagtttctattgtgtggttgctttatagggtctgtgagctgtgtgcttaattgtgtttttgtggtagaaggttatttttctttcatttccacgtttagaattcccttaaagatctcttttaaggctggtctagtggtaacgaattctctagcacttgcttgtctggaaaagattttatttcttctttgcttatgaagcttagtttggcaggatattaaattcttggttggaattactttaagaatgctgaaaataggcccccaatcttatacagtttctgctgagaagtccactgctagcctgatgggatttcctctgacctttttctctgactacctttaagactttttcattagctttgaccttgaatcgttttgtgattatatttcttattgatgtttgttttgtgtagtatctcacaggtgttctctgaatttcttgtatctgaatgtctacctctcttgcaagattcgggaaattttcttgaattattccctcaaatgtgttttccaggttgtttgctttttctccatctcaggaatgccagcaattagtaaatttggttgctttacataatcccatatttcttaaagactttgttccttttttttgaattcttttttctttatttttgtctgactagatcagttcaaaagggcagtcttcaagctctgaaattctttcttctgcttggtccagtctattgataaagctttccctaatattttgaaattccttaagtgagttttcaattccagaagttctgattgacttctttttaaagtatttaccgcttccttcatttcttagaatgatttagaagtttctttgtgttgattttcaacctttttttggatcccagtgagcttccttgtaattcatgctttgaattctttatctgtcatatctgagtttccattttggttaggggccattgctggagagctagtgtgattattgagtggtgtcactacgatcagatttttcgtttggccagaattcttgcactggttccttctcatctggagacactggcacttttgatttttgtaattattttcatgcaggtaggatttttttctttttttgttcctgtccctgtaatattttttttttctttccctttccattccccaactccctaggggatatgattgtagagaatgctgggtagcatcttttggctttgcttctatagcctatgtacttctttgggcagattttatattgggctgtagggttcaacctacaagccagtagatggcgcttacgggtaagatcacttagccagctgtagccagtgtgactaggtatacacttgatacttgtttacaggaagaagctctctgttgcctcaggcattgggctgatacgtggagtgcacagtggtctgagctacttgctcagccccaggggagtgggaagcaagatgagtggggccaggccacctacagtcccctgatggcaggcacaatcactaacactgagggagaagccaatgggcagccaccaagcacccagaggtggtcctaggcatggagctggcaaacctccttggccccaagttctctacacaggcaggggtggaggcctgaactcttaatccaggagagtgggtactccaggtacctggagatctgcctgggtgctgcgtacagagggccctgctgtaccacaatctctacacaggaaggatggggtgtctcaggctagcaatccatgcaaatgggtcctctgactgcctgaagctatgcccgggaatggggcagagagtgccctgctttaccatggtcttggcatggggagagtgggctggcttagcctgctgatcccggtgaatgggtgctccagttacctggagatctgcctgggtgtgaagcagagaaggtcctgctgcaccccgacttttgagttttaggagtattcacatagcatagatgattcaggcaccaaatcctcatgatgtctttgctaaggccaagaggttttctttgatgtttgcctttgaaggtgtttttaatgtttgaatttacccttttcctggtgttattgtccttcttgggccctgtctttgtctgatagtgtcttacctgactttcagaggcctaaacttttttctcaatcctttccaaccctaggttactaggattcatatatgccccaggagtatctggaagctttattacttgcttttctgcctattgtatcgattcatttccattcttttttttttttttttttttttttttttttttgctatggggtttcattctgttatccaggctggagtacagtggtgtgatcacagctgactgcatgcagcctcaaccacctggggtcaggggatcctcccacctcaacctcctgtgtagctgggactataggtatacaccaccacacctggctacttttttgtttttgttttgttttgtttggagagacagggttttgtcatgttgttcaggctactcttgaactcctgggctcaagtgatctgcctgcctcggccttgcaaagtgctgggattacaggtatgagtcattgcacctagcccattttcattctttatatcagacgtttaaaatagaaatgttttaagatctctagcccagcatattctcatatctcaggcagtgggaatcctcttggaaaattttcaaaagaatagtttctaaagcccaaccacacctacatgtcagaatctctagggtgcagggcctgtgggtatgtttaaaagcctcctagataattctgatgcactgcaagtctgagaaccactgacatagaaaaagttatttcttcatgtaaacttagataattaaataataacagctagtgtttattgaaaataaggtaacatatattgtaagcatgcactaattctagctgttagtattaatattgttatatgctaggctccattctaagtccttcacatatcttgtcatttattattcacaagaatcctatagctaccacttgtattcccattttagagattagcaaatcaaagcacagagaaattgaattattcaagtttatatagctagtgggtagcagaattgttatttgaatccaagtagtcattctgattccagagcatgtaatcttaacctaccatctttacagtcttccaggtgattcacagagttaattttattgattcccaaagggtttgtgacattacagaatatagcaagaaaaatatatttggataaattatgtatttatgttgattttgtgtaggtattgaggaagcagaataacacagtagaaatggcctcagtttacagtcagatagacttaggcatgaatctctgctcaactgcttgttactagtagctatgagaaagtaaattatcacagacctcttattattttgttggtaaaggaggataactatttttacttcatggggtttttgaagaaataacataaaatagaacctgtaatatattgcttggcacacagtagatggttagtatcagaacttaaggaatcctctaagaagttatgttggcttctctgcaggagattgtagtaagccttagtctaggacgttgttgatggaatagctgatgggtactggtcgatggtgctggtgggggccaatgctgactgtcaatgttgagaatctaacaagtgccaagcattgtcctaggctctggagataaaacggtgagtgagacatagtctcactgctttcaagaagcttgcagttaacttatctatataatcagatagatacatacacagttactttttttgttagatgctaggacacataggagggttactcagccaaaccattgcagatgaggaatggctttctagagggaagaggatgagaatgtgagggattagagtagtaagtccagataggaggaaaagtaaaggctggctgaaatttgtcattactacaaaggtgttccattcatccaacatttatgaaaagatcagggatcttaggaaacttttataaggacagtgttagaatattaagagcctacttttaggttcagtttttactaaagcagacaatttttcaaagtaaaataaaaatggcactctttatatgtaatactgaattttctatcaaatagcactttttggagtctacatgcttgttacttggtagcattgtcacattaggttatacattagaggaagagagaagagaaacaaaggaatagtaaccttcagaggatggaaatgatgatttgtatgtggggtgaatttcatcatgagttgtgtctgctatttgcacatttcccttttcctaccatcctttttcacagatgatgaaaaataatttgttacatagttaccatagtacatagttttaatttgataccgtttgttgctcttgtatggatttgatagttgagatttctttccatctttctccaatgttcccaataaaatagcatattaaaaatgcaagagaaataccatttcttttggcaaaactgggaaaagtgaaagggaatgaataaagaatttcttggaaggggaggaatgtgagtctaggggaaggaagatgatgttgtaatggataaaatgatatcggggattataggaaaataaatgaagttggtctttaaaaatacccccaaaacagaggcagcagttctgcatgttttggtaacctgatgagtgtgacttgatataagagtacacttttgatctcctacttgcatatctgtatgacacctacctagaagtactgtagttttttatatgtactgtagtcctgctcaggacatgagcagtccctgactagaactgaggaaagtagagcagttagtgtgggtatttggaaacattggaaaacagttgttaggggacttaagctcttaatccctgaggatttagcagaggctagaaagaggaagggaaaaatgaaatccagtctgtaaaaaattgattctgaaagcgatactttggaaagtttataaaatgaggtcgaaattgtgaacatagacatgtttactgtgatgacaaatcttagtatactaggagtagccaaaaccttggatggagagatacagttttagacaccacccctcaaaaagagactttataatactgtcctacaaacttaccatcaaatacttgtttgcatctttatggtatgaagttggggaggatggtagaaatgttgaacataaaagcatgttgctccaatgactgtggtgttgttggggtatgttgaatttcagggccctttgagagaagagtattcatgcctaattggggtttaaattttagcagactcttcattacctttgggcacttttttctaagagtttgttgtgattgttttggcaggtacaaaaatccttctcgaaactgaacgttatgatctctccacctcaacttctgctggttttccttttacctctatccattttctctcttttttacttgttcttccagctgtaacagtgtccctcttgaaatattgcagtgcttccatagtaatccattctcttctctttctgcacacgttctgttggtcatctcatacactccactatcattaatgtgttagtgattccagaatcctttatattccacttctttgaaagtcatctgaacatatcttcttgggtgtcctgttgccacctcatgattaatgtgtacgtaactgagttaatcagcctctccctcagacatctgttatctcccataaactcaggcttggctaaatggcattaatgagtccctcatgccaggaaccttggtgttcataggagcttattcagagaatataaacaaagttttagccagaagatgcctcatcacagtacctgtattttatttaataccaaaaaacaaaaaattggagccaatctgaagtcataatcactgcatttcttaaaaactgtgatatacacacacacgcacacacgcagaaatattttacagacagtaaaatctctgtggaatatttaatgacatgagaaggaacatatgtaaacttagtgaaaaaagatgctcttaagcaatatattcattataattccataattattaaaataaaactatatagagatatttatagaaagaatgcatatgcagatattcactttaattctagatagtacagctatgggtgattttaattttatttttatttacctgtattttccaaagttgtgtagtaaaaatgaattacttttgtaattcacacatgcagacaatttggcctccctttttcactcccaacacttgttgaattagtttaataatgtcttcttcactccaactattgctgcttagttcaactactcattatatctggataagacacggcagcctcttgactttgctgctcagctgccaagctcccttcctgaaaatccttactgatgcagttcttcacttgcttcactgttccatttaagtggctatatattaaatctcaaaaaccatcaagaacagaggaaattgtgaatgttattccttgtaactagtttaccatctggtctgaagaccttcagccaatggaattcagccaactcaagatttaatttaatatattcacctaaccttaaccaagtgacttttaaccagagcatggatagttatgcagatttggggtgaggagaggtgaaggaaggaagggtgggagagaaaatatgatttgaactcaggccttcacaaatctgtgctcattccttctgttctacctctacaaactgccataccttgcccttgctgggtgtatgttcccccctcctgtattcaataaacagttcattggttttttttttgagcatttagccagtaagaacaaataggcaaataatgaaaatccatccattttagtgccagttattctatcagcagatcctattagaagtatttattgaggcatgtcatgctaatagtcccaaagtgtaattatacttgcagatttttcttgctttcagagagtttgtaatatgttccagatggttaaataggaaagaggagacaatttatactgtcttttcacttatgattaaaaatttgatgttacttactacttatgttaccattattgctttgttggatttttacgtgagaggaatttaaacaaaatgtgtgatttttaaaactcttctgctatagtcaacaattaacaggacgtttcatagtttctttcaccttgttagttgtttaattgcttctatttaggcatcattaaaatgatataattgtgtcataagtagtaattcttttatgaatgtaacctttattcttggaaagtattcacttgggtttgttttagacttaaaattaaatggtgaaccttcttgtgaaagcttacatgaaactgaaaaagaataattttccaaactgttgaagattctttgaccttttcccacaaagtattaataatatggccttagattcaaaattagtgaatctactaccaatagtaggagtgatcatttctcattgattcattcatactctctcaactacccttatctgactaacgaactacttcttttgaaaggcagcttaccaaacattgggaatatagcctgtgaactcagtttagaacagttaatggatcaaaggggtccagacccagagccttgacttcattatgaccttgagttaaccaataaactgactggttggttaacttggagaaatatgttgtttttcagtaagagatagaatacttatggtgtaattatttggtcggggcagggggacagattggttttgatccttagactaccattctctgtccttgaagttctcttccagacttcttacaaacaagaaaacaagcaaaacattttaaaaataattatagttatataattacaaagataattataaaattatatttttggtgataaataatagagattattcctaaagggttttttgggggtataaaaggagtagtttgatccagcaagatttacttcctataaattgcctttaagtatctttgttctttctcagattttcttgttcttctttaactggccacatcctacctcttcctgaccttctctccccaaaacagcctaccctctcagtcttttcagactcctcagtcgttcctcatacttactgtacagaattctttccagtttttctgggtaaaattcttatcctttctacaaaatttaaattccttctcagcaagttcaaagcccaaactaagactaagaaaagcatgcctttggggagactcagttcatcttgcaataataaactggcaataatttcagatttctattttcattactattgccaaactttgtataatttggtttgttcagcttttacagcaaacctcatgttcagattgttattaactattcaatattggctgggcgtgctggctcacgcctgtaatcccaacactttgggaggccgaggtggacggatcacctgaggtcaggagtttgagaccagcctgaccaacatagagaaaccccgtctctactaaaaatacaaaaattagccgggtgtggtggtgcatgcctgtaatcccagctacttgggaaggctgaggcaggagaatttcttgcttgaacctgggaggcggaggttttggtgagctgagatcacgccattgtactccagcttgggcagcaagagcgaaactggtctcaaaaacaaaacaaaactattcaatattatgagtctttctgggaatatgcaaaataatatagacaaatttaattcttatttttgttgtatgtttttaaagtgttttgtatgttcactggctcacatgtataaaaatttgattttatacaaatgtgttaagatgggattaattttttaaagaatgattcacagaatttcattgaatggaatattgtagcttatatataaagaatgtaatttgatttataaaaatttaggatatgcaggacctttctatgctacttaagtaagaattgcatatgtgtgacaaaatttaagctaattagggtaagtatctttctgtgttagtggtaagagataataacaggatatttgaaaagaaatgctactttgaattcatgataccatgtttcttcttgttaactaagctagaaatttttccttattccttctttggagtatcccagccctcttatctaccctgctttcgtcatgggaagagttgttactgtgattctcataatcttgtgtggtatgtggggggtggggaggagttcccttattcacctggcccctttcctggaatatggcatgtgaaatgccttgtcttgttgtgaaacatttagaaaattacagtaacggcacttcagtcctcatctttcctgaggcttcctttgtccccttattatatatctggtatatttaaaatctcttgtttttttgttttccgtttgaatacttgaaccacttcagtgtctaattgaacattgttattgtctagaaattcagatttcattttttgtgttatgtgtgtattcaggcagatttttttttttttttttttttttttttttttttgagacagagtttccgtctcaaggctgcagtttcactccgtctcaaggctggagtgcaatggtgcgatctcagctcactgcaacctccacctcctgggttccctcctgggttcaagtgattcttctgcctcagcctcctgagtagctgggattacaggcacctgccaccatgcccggctaattttttgtatttttagtagaggcagggtttcaccatgttggccaggctggtctcaaactccagacctcgggtgatccatcctcttcggcttcccaaagtgctgggattacaggcatgcgccaccacgcccagcctttcaggcagctttctaagcagcgctcatgaatttgaatccctgtaggtctaatttgtacctaatctctgtctttctgtatcctaggaagctttgttaggaattgatacatgcctttgtctcatttccccaaacctaatgtttgaccgtatactgttagctgactgtcaggttctgttcacagagtgacacctctagtccccgcatgttttgacatgttaactgtgtgagaggaaaatgctcagacactcctgagaaatcaggctgcatccacttacatatccagcaaaatagatgatgaacataggagaaggagaaccatacagcagtttggtttaatgcacactgacctccagtatagccagttagtatacaggaatttgacctaaataagaactgttgttttttttcccttctgaggagaagcatttgtagccacaatggtaaaaaataatttatcctcatataccactgtttctcaacaacagcactgttgactttggggtcagataattctttgttgtggggactgtacttatgcattgtaagatgttcagcagcatctgatatctacctagtagacatctgtagcactctccaccctgagctgtgataaccaaaaatgcctccaaacattaccagtgtttcctgggaggtaatacagccccagttaataactactgccctatacttatgattatgtctttgtacttttgattatatggtgaagacaaattcttagaagatagattgtgcattgtaattattttggtaactccagaaggatataccaatttctattccaaaaacaatataagacattgtatatttccctagacccttaccagtgctggattttgtcagtttttttagtcttttgccattttgatagatgagtaattacattgccataattttaattcaaacagttattaagaaggttgggtatatcagaatttttattgcccatatgcagatcatcttttgtgcattgcttgcttttgttcttggctcatttttctgggggtattaatttggtcatttatggtttctcctagtaggttgaatttattgaggtgtcacataaaagatactcaatagatttttaagttgaatgtagaagaacattggtacttctctaaggaaagagagtatgtatgtgttgcatgtgtttgtgtatgaccatgtggacacatgtacatatgttcatgtgtatatatattcatggggacagaagagcagagggctaaagacttgagctgtgtgtccacatttaccaggcattacaaggatattgagaagaagcggaggacaaccagtatacttttcttggaatatgtctgaaaggtcaaagagaaaagtgactaatttgctaggaagttcacctcaaacctccctagccaaattctgtaaggtcaaacaagtgatgaatattcaaaggactaaaagaagttagaggtggaaactcagaaaagtgatatagtaagagtatgagaatgggaggcttaaatttcatagcattgtctaagtaatgtggtatttgggagagctaagtatagattggtgagacagcccagcttatatggattacctatggaatttttttactttctcatttttatcagggaatttatcttcttcactgttcttggatatcatctaattttctttttctgggctccagatctctgtctttgtctttgaaagggtctttgccctcttccttcagagcacataaaaagataataagaaatatgtatctagggcaaaagttctcatcatatggtctgcacacccctcggagggtctgtattaggctgcttggactgccatagcagaataccacagactgggtggtttaaacaacagaaatttattttctcacagttccggaaactgaaagaccaagatcaagataccgtcagggttggtttctggtgaggcctctctgtatttggccgccatcttcctgtgtcctcacattacctttcctctgtgcctgtgcactcctggtgtctcttcctcctcctataaggacaccagtcttattggactggggctccacccttaggacttcatttaaccttagttacctccttactagccctgtctccaagtacagtcacactgggggttagaacttcacatataaacttgagaaggggacacaattcagtctataacagagcccctaagaccttttcatggagtccacaacatcaaaattgttttattaataatattaaggtgttgtgttccttttctgttgtctagacattctcaccaatagtgcaaaagtaatggagggtaaaattggtgccttctcataaaccgaggctatagtacccaattgtattcttggttattttctttgttactccataattgcagtaaagaaaaaaaatgggttattaaagggctattctcagttttaactgacaatacaataaatattggtaactcatattaattaaacctctttgggtccttgataatttttaaaagtataaagggatccttaaaccaaaagaatttaagaactgatgatctatgggaaagaaggggctattaatcaagtaaatttttctattttctgttcttgattcataaggcaaatagttctgtcataatcagagaaaataagcttttatttttagaaagtagacagattacatttctgtatttaataagaacaaaaagttttcaatgtatgcatattcaattttcaatagattctctgcccctgttctccctgcctaccaaccctgcttcccccaccagctttggtccttgcttctggtgagaagagtcaagggagttttcttaactctggtccatttacttgttcaaatgctactgagtgttttgttgatgaatggcagatacaattcctttcttagggaagttgctgctaaatgatgaaacaatatatacatatgcaagatattactctacgtatcaatatagaatattttgaacagaatattttccaggaagtaaaaataacagttcttataagtggattttgagctgactcttggggtggatgcatgaattgacagagagaggagaggaggaggagaaagagtatgtgtagagaagggtttgacaaacttttactgtaaaggaccagatagtaaatgctgtaggcattgccaaccatacgggagctactggactcagctggtgtagtgtgaaagcagccatagacagtaagtcataaacaaatgagtgtgagtgtattccaacaaaactttgtttatggacagtgaaattgagttttatataattttcttgtctcacggtaagaaacaaatgagtgtgactattccaacaaaacttttttatggacattgaaattgaatttcatgtaattttgttgtgtcatgaaatattatgcttcctgtgttttttttcaaccatttaaatatgtaaaaactggccagatgtggtggtatacacctgtaatccctgctactcaggaggctgaggcacgagaattgcttgaacccaggaggtgggagtagcagtgagccgagattgcacactgtactccagcctgggtgacacagcgagactctgcctcaaaaaaaaaaaaaaaaaaaaagttgaaggaaaggtgagaatgtgttcatggccacatgaactggggatttaaaaattttgttgatcttttcaaggaactaacttttgctttgttaattttttctactgttttatttctttcactgatttctgcatttagattatcttctttcttttacttcctttgggtttactttgctcttttcttcctagcttcttaagatagaaccttgaaatctatttcccccaaaggagacatttaaagctataaaatcttctccctcccctctaaacactgccttctctgtgctctccagatgtttgtatgtatttttatttgtacttttcattacattccatttgaaataattcagtgttttctgttttgttttttttttttcctccatggattatttagaagtgtgttggttttaaatatttgaagttttggagtttttctaaatgtcttactgttactggtttttaatttatttcagttgtgttcaaacagcacactctgagaagtttaatccttttaaatttatttcgacttatcagcataaatcatatcagtcttggtgaaattacatgtactcaaaaacaatgtattctatagttgttggatatagtgttctaaaaatgtcacttaggttgaggtggctgatcagatctaccatgtctttattgatttttgttttagaggggtctggttcttctatcaaatggtgagagaggggcattaaaatcttcagctgtagcagtgtgtatgtttttctctatttaatttagtcactttcctcatgtatatttaagctctgtcattgctggctgtgataatgggagaccttgaatgcaaggtagcaagtgtgaattctttatggaaaggcactgttgagtggtgactaggggtgtgacattgtgacatgagatgtggggacttgttcagcaggatatactgcataggcagaccagggataggagttagacgtgctgctaaagtgcttcagacttggattgctaacagtatggagtataatgatgatttgaaaataatgaacgtgatgctgttctgataaacactggagagagaaaattagcaggagatttcaatggattgaatataggaaaagcaaggcaagctgactgaagcagttctaagaaccgagagagctgggaaagtggtagtatggttgctggtgatagcagtgtatttaatagtgactttaagtggtagagatgaggattttctttttgacctaataaattttggatgttacctggatatctaaatatggcatcattttgttaatagtgagaagttcaagattggtaaaggaggataagaatttctactgggttttcattgcatgcatactatgaaatcattgatttctgaataattgtgggattaagattttatatgtggtcttagctcagatattcccctaatatataaactcttcttaatcactattctaaagtatctctcctagtcactctctacttcattattctgttttcttttctcctattagaatgtaagctaaaggagagttcaactctgtatccctagcacttggtacaatgcctatcacatattaggcttttaaatatttgagaattgaatgactgcctgttagaaagagaaaatatgtatactgaggtatactgagtaaaagaaataaaaagcaaatgttttataatttgattttaaaattccttactaatgtttaatacctgtttttttgttttttgctgttttttttttttttttttttttaagttaaggctaggtctctgtttgtcattcctcaccccctacccccactactgtgcatgtcaccatatggaaagtgatggttacatgtgatataaattagcacactttgttatataattaaactttgcatcccccaaaaatggaattacttattaaaatctctaagtacagatgctggtcactactctactttaaaaggtaatatgtaatttagaaatatgataaaaataaatctaaatacttggaaacaaatagttttactgttaactttagtagctgttctttgctatccttaaggggtacgaagaactggtaagactgtcgttgtcagttagcagtgtggtagagtagatagaacctgcacatagaaaaaattagtaatgcaaacagttatctgataaaatctatgccagttttaactatcacctaaagagatttaatatttactttttcttgggccttagtagaatgccatcttctaacacatataaaacctatattggaaattaaaatcctatctgagtatcctgccataatgttttggagatttagaacaacttggttttgatggtcctcagtagaagctttttgattaagtagagttgttctttaggaaagaactaaacacttgcagtttaggtgttaggtttaatttttaggtttttgagtgtggattttctctgacatcttgttttctcttgccttgtggcaaatacagagagaaattgtattgcagaatgatgatacaaaaatgctcttcctccaagtaatagaggctaatctagcagttttactaattgtgttttagtttttcttcctccctctgttctcaccttcaaatctgtgcctaattccttatattaataatctgggaggccgggcgcggtggctcacgcctgtaatcccagcactttgggaggctgaggcgggtggaggacctgaggtcaggagtttgagaccagcttggccaacatgttgaaaccccgtctctactaaaaatacaaaaattagctgggtgtggtggcggacgcctgtaactccagctacttgggacgctgaggcaggagaattgcttgaacctgggaggcagaggttgcagtgagccaagattgtgccattgcactccagtctgggtgacaaaagcgaaactccatctcagaaaaaaaaaaaaaaaatctgttatgtaccccacctcgtgccattattctgaagctcatgggtttgtatagaaaaatgtgtaatgttctttgaccagtttaatgatcagagcttattctctttgagcttttaactatattaggattgttgaattagagcaggttcattaattgcatatattaattttttttaatgttgtgtatctactctgctccagattaaaaatacctacacggagcttacagttgagtgagagagatacacaataaacacataatcacacaacaaatatgtaaataaaatagtggaaaatatgctgtgaagaaaacgtagaaaatgctatgaaagtacagtggaggctgatttagattactgggttaagagaagtagaattttagctgaagtttgaacaatgaataggaattggatagatgaagaaggtatgagggattattcacagcagataacatattgtagggaaggccttagagtaaggaagaaagattggggaataggagaaacttttaggaaagaccagtgtggttaaagcatagtatgctttggggagagtggctatgctgtgagttttggattttatcataagtgagataaaaccctgtggaaggggtgtgtaagcaggattagaatagtggatttgtgtgtgtgcaggggaatagataaggtggggcttggtgattgaataaataaagtgtgatagtgtaaaaatttaaagggtggtgatatctaggttttgggtagcagcagttgaatgggtataaaggtacctttttaaggatgggaaaaagtaaaggagaagggaggaatttagtttggaacttaataaataggcaaatgcatgcaggcccttagaatagagcattaaaaaaattagcaacagtcttttgagaatagtttgtcttcaaaatagatgtgtttatactgcacccagaattagtaatattgaaatatactagtctatttcagtgcttatctgtttaacataaatataatggtgcgtgtaagagtcatgaatattttagatttagtagttgatatacagacttgtaaacacacagtttataaaagtttataatctgccttttttcaaaaggagcaggaagtaaaaattaagatataacaaaataactctgggttgacctcttactgtactgtttgggttttttttttttttttttacactttatcattaaacttagaatgtaaacatttatatcttcctagaaacaatgagatttaaaaacaaaaaaaggtacctaaaatctcctgaatatatgttactgaaacaggaggatataatgaataattaaaggaatgtgtgacatccaagtcagggaaaaactaagggaaaacatgatgccgcaatcatttgttagaaaggtggctgccaagtagaagacaaattaaattaaatttagttggctgtagtctggttattaatcaaacactttcatgttgtttatcatgtgccagacactgttttaagtaacatacatacatatatatatatatatatatatatatatatgtatttttttttttgagatggagtctcgctttgtcgcccacgctggagtccagtggcgtgatctcggctcactgcaagctccgcctcctgggttcacaccattctcctgcctcagcctccggagtagctgggactacaggcatctgccatcacgcccggctaattgtttttgtatttttagtagaaacggggtttcactgtgttagccaggatggtctcgatctcctgacctcgtgatccgcccgtctcggcctcccaaagtgctgagattacaggcgcgagccaccgcgcccggccgtaacttattaatgtttactctctgaacaattcttgactaggtacaagtgttatcccactttttgtagatgaggaaatggaggcatggaaagattaaggtcaaaaagctgtaaatggagttgaactccagaatctatacttttaatcttaatgctatactgtcttggttataagaagggaatgtggttacctgtaggcagatgtggataactgaagctgttaatttatttcactggtgtgaagttttattgtatcaatataccagattctattattgatgggcatttgagctgttcctattttttgctcttataaacattgttagcatgaactttcttcatatatcttgttgcacatatccaagaaactttctctgaggcggtggttctctttattactggtccactggtggaattcttgccacttactaatggtgctcagatatattacttggaattcttgctctggccacagagcaacagttttcatatctttccaacataatgcagttatgtcttctaacagcactcatgaattcttagattttttaagtcacctaaaaaattatgtgaagaaatgagttcttttctggagagagactgcaagtttttcataaaagcattttgtaatcataaaaacaatgaaatcactttttttaaagtgaaagataaaaaaacaagtaaatattgctattctattagaaaaagcaaacaactttattgtaaagtctatgggaaagtcaaataaactttatacatgtatcgaatattttacagcattttcagtgtttacaatgtttttaacattaatatggatggtttgatttcaaattttttaaaaatctttttcatcttcagtttggaaagcatgacttgtgtcatcattgataagaaagttggtaatattctttcttcattcttttattaaaatcttgcattttttcacccaaaatttgatctcttaaaaccacctttttcaggcaccttctttttaaattttatttggggtaaaattaacaagtatacataagctactgtggaattataactccatgctaccaaaataatttataattgccattagtgttaatggtttatttataatgactcactactggatggcagtacacctaacctaaactatgagtcccagaacactgggaattttgactagctttattcttttctctccccatcaaaaagtatatcctaaagaagataagttaaagccacgttataataatcttgaatcttctccaattttaaataaataatatgtaaatcattggtattttaattgtttttgataacaaattttcatcacacctcacagtcagtataccggggtgagagaatttactgtcctttaggcatgtaaatactgtactctagttggtaagtttgtttttttacttccttacaagagagaacattaagcgatacttagataaaatggacttaagaacagtgataaaaaagagagggaacattaagccacaatttcttttgacagtcatatcataaggcaatatttggtaatggaagatggattttttttcctgctttataaaagtcacaatcaatggtgtcagcttgtgtgtacagagggacgttctcttggttgaaagctggttctttttcacaaacctttccaatgaactgttgcataggccttgctgcctattgttaactctatttctgtcatacaattctttatgttattgagtaatttctgttgcttactgcttctcaatgtcaggatagtggattcttaaattcacgaaaaaattaaggtgataatatatacatgaagtaaaaatttttgaataattacaaaataacaggaagattgaaataaataaaatgttagaaataatatatagtatttggttccatgtaaaagtggtagattgagcacttagtattgttcactctcaaaacagcagtttagttaaacaacaacaaaaataggataaataaggattttttaaaagtcataaatccagggagactaggagaatgggagggaatatgacaaaatttttgaaggggtagaacagctagaatagtagtagcaatctcactaaacttgagaaagccagttttaagggaagaaagctgatgaccagttggactgatactggtgaatcttcaaaaggctcggatagtagtagtatgtaactctggaagttaagaagggaagtgaactaaaatgaggaagatggtttcaaagctatttaaaaagccactagatgcactgatatccttcttcactctctgtcactgtgcttatgcacttctcccatcctgacaagtgggaggcttgaggtccatcttataggttaaaacagagggtctcttggctagtggacaccagtcacattgaaggtggagaggaattaagtgagtactgacatttccaatgctcagaacccctggcccccttctccattattggctcccaaattgaaaactaggccctttagcatccaggcaggaaataggaggaatctttttgggaatcccaccaactcaaggagaaaaacctaaagacaaaaagaactatacataaatactgtactccacttggtaagtttgtttcttataggggtataggttaacagtgtaaactacattacctgtatacaagtgtttgaaaaataagctaagcattagaaaaggggagccaggtttctcacataaatatttatgccctcacaaagagcctggacagattgccttgttgtagggaaggtcataattgataagtcccatgtatataactagaactttccatcaactttgtgtacccaaacaactaaataccattgggcatctgagaaagcttctaatatgaataacagaaaccaaaataagcaaatagagaaaaactggagaaaatagactatgccacctagaaaacttgatgtatatgtatgcatgtacatacatatatacatatacacacgtacacatacagccatatatagatacatatgcatacacacacacatatatatatacaaatacccagatatgtgcatgcagaaagactggatgctgcacccataaagcaagaatgggatatttaaaaaaaaacattcagagaacaaaaaagaatttttaccaattaagaacatatagtagaaaagaaaaactcaaagaaatattggacattaagttgaggaaaactttctagaaagtagagcaaaagggcaaagaaataataaacagaagataaagtaaatatactagtgcaggagggccagctctgtattattaaacattccaaaaaagggaaaacagaataaatgaaaagaaagaaaaaatgaatagtatatttcaagaaaatttctcataattgaaggcgaagtacttattgagtgcttggcgtaatggatgaaaagagaccaatactcatttaaagaataggaaatataaaaagcaaacttagatgcctaggctccataatattcagggaaatacaaattgaaatgagatactatttttcatccatttgatagggtaaattaattatatcaatagcattgggaaggatatggggaaaatggctgtctcaaactacacactctgggggaagtctgaaacaattattttggtaaacagtttgccagatggcaagtggagttggacatatgcaaatattacaatctagaaattctacttttggatattgccattagaaattcttctacttatgcatatgaagatctggacaagatgctatgtataagaacattcactgagccattatttgtaataatgaaaatgtatggacaacctaaatacaaaaatggctaagatgtggtatattcacatacacatatgaacagaacacatgcacacttcaacatggatagaactccaaaagataatgtatgaaatcagcaaaatgcagaatatgtatgatatatatacattttaaacatatatttcaaaacataaaacgttatattgtttatggatatgtgtatgtcctaaaataatataaaaaattgaccagaaggtatgtaccaaattcataataatggttacctctatcaaggggagggggaaggaacagggtaggcttgagtatggggactttagctttatcagtgatgcttcatttctttaaaaagaaaataaatatatcacaatgttactgttgttaattctgagtgatagatcataggtatttagttgttgtgtttttctttatatctttaaattctggccctttgcctaactccaaaataacaaacaagaatgttttctagatttcctttttactccttctatgtgttaggtacattataggtactcttctatcaccttgctttctcatctgattcttaaatgggaattcaggtactgcattaaccagtacatacgccagaatccagcatcagaagtagataatgaagacagaaggtcctttacccatgagagacaatttaaaactaggaattggaagcttcagtcatgtccaatagctgtgggggtttattaagggtttgctccatccatctcaggtctcctaccctggattcctaggggaggaaccccccccccccccgcccccggagacaagaccacactctttcgcctaggctggattgcagtggcacaattatagcttgcagcagccttcaacccctgggcccaggcaatcctcccgtttcagccccccaactgagtagctgggactacaggcacacaccaccttgcccggcttatttttaaattgttttgtagagacggggcctcactttgttgcccaagctattctcaaactcctggcctcaagtgatcttcctgcctgggcctcccaaagtgttgggattacaggtgtgaggcaccctatacctgccctagaaaacactttcaaaatactgaactctggattgcacagatgatcatgtaataaccatgtaataattactaaataattaatatttagaagaataagcttactgattccataataacaaacatcagatgatctgcatcattcttccccccattccttcatatttctcctgtcttttttggtctctgtgtgtcacctatctcttggtttttatatttttcacttctgaccatttgcatatcttttttgaatatggattcatcatgtacttttctgcctttgtgcagtccctaagtaagtgtgctcagcctcccatcagcatggtttccctgttcccttgcttgactggccatgagttcgtcagcatgagcaagctgttctggggatcctgaatcattagtaggaatccatctggcttcagttactgcttggttttgaaaaagttctcacaaaaaaataaaaataaaaaaataaaaagtactcatgaaaactgtcaggttttataaaagacagtggcattatttggcaaacgtagtaaagtacacaaatgatttttgggagtgccttttcttggaagtcaaataataagagagaacctaggtttgtggatgactatctttgccatatataatgactacttatcaattacaaagtaataatcaaaaggaatctcatcccctacgaaatgttttagggcactaagtttattacaaatgcagataaactagacatatacaatgagaacaatgggctaatctaactataaatccctttctttaatagtttaactataagccaatatgaagagctggaagtttaagtttctttgagtttttgaagtatgagtttaagtcaaggaaagaaaaaaattgaaaatataaaaagcatttaatttggaggggcagtaagaggtcaggatccggttgataggaacaattcaatttgctgacattaaacattccaccttaatatggaatttaccattggggaaatcatcatgatttagagaaaatacagtttttatataaaaagcaaaaacccaaaacagacattaaaaagcattacaaatgtattgttaaaaatcggtttgtatttattgatagtaaaatacatcagatatgcataaagtaaaccattcattttcttttcaaatatatgaattaatctgggagtggactaacatcttcacactattcagtctttaaacccatgaacatgttaaaccactgttttttagatctctttttgtgtctttcagcaaagttttaagtcttgccataggttttattaaattaattccaaagtattttgtttttgatgctattataaataaaattgtttttaaatgttattttccagttgtttgctacatttgtatagaaacaattgatatttttatattcaccttgtgaattcaccttactaaattcacttattgcattcaactttgtatagtatattcaccttgccaaattcacttaattctaataattggttctcagattccttaaaattattgacacaaaattcatttttaaataaataaagacaattttagttctttctaacctaacttttatttctctttctggcctttttgccctacgtaggaactccactatattcaatacaatgatgaatagaagtagggagagtgaacattcttgacttgaacgcagtattatgagaacttgcagtattttaccattatataaaatactagctgtaggtttttcatttatctcccttatcagattgatggaataacttttaatttttagcttactgagagttttatcatgaatgggtgctgatttttctcagatgctttttctgcatccattgagttttttttaagattctgttaatatggtaaattatgtagatttaaattttttatgttaatttttaaattgacaaataataattgtacatatttatgggatacatagtgatgtctgatacatataatgtatggtgatgagctcaggataattattaatagcgtatccctcatctcacacatttatcatttctttttttttgagattttttaaaatcttttttttattattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccacgtgtcagggatctagaacgagaaataccatttgacccagccatcccattactgggtatatacccaaaggactataaatcatgttgccataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacatttatcatttctttatgttgcaagcattcattaccttccttctagctgtttgaaactatacaatatattgggggttttttgttttgttttgttttgttttgttttttgagatggagttttgctcttcttgcccaggctggagtgcaatggcatgatttcggctcaccgcaacctccgccttctaggttcaagccattctcctgcctcagcttcccaagtagcgggaattaaaggcatgcgccaccatgtccggctaattttgtattttttagtaaagacggggtttctccatgttggtcaggctggtcttgaactcccgagctcaagtgatctgcccacctcggcctcccaaagtgctgggattacagacgtgagccactgcacctggccgaaactatacaatatattgtttactgtagttatccaacagtggtatagaacactaggacttattcctcctatctagctataattttgtatccttcaacaaatctctctctatccctatccctcttccccctacccttcccagcctctagtatcttatgttctacttgtatttctatgagatcaacttttttttttttttttttttttttttagctttcacataggagtgagaacatgtgatgtttaattttctgttcctggcttatttcacttaatgtcttccagttccagtcacattgccatgaatagcaggatttcattcttttttatggctgaatagtactctgttgtgtatctatgccacattttctttatccattcatctgttgttggacacccaggttgattccatatcttaactattgtaaatagtgttgcagtcaacatggtagtgcagacgtctcttcaataatactgatttccttttatttacctaaatgccaagtagtaggattgctggattatatggtagttgtatttgtagtttcttttcttttggggaacctccatactgttctccatagtggttgtactggtttacattcccaccaacagtgtttaagagttctcttttctccacatcctcatcagcatttgttattttttgtctttttgataatagctatcatcctaactggggtgagatgattacctcattgtggttttgatttgtatctccctgatgattaatgatgttgagcatgtttccatatatttgtatgacttttggtcatttgtatgtcttttgagaaatgcctgttcagattatttgcccatttttaaaatcagattgttgttgttgttgttgctgttgagatatttgagttccttgtatattctggatattaatctcctgtcagaagattggtttttgaattttaaatcagccttacattcctcggatataccacttgataatagtctattcttaaatatgtctggattcaatttgattttttttgtaaatctgtactcatgaggctgattttcttttccgttaatatcttttccaggttttagtattagggttttgtttgcctaataaaacacattgggaaatatcctctcctattttcctgaaagtgtgtaagattgctattattacttccttaaatgttggatacaacttacctgtgatgccatctggacctggagttttgttttgtttttaattacaaatttatttaatacatacagtctgtttctttctgtggttattttaataaataaaataaaaaaattaattttttgagatttttcatgttatctcagttactgaattgatttttattacgttgttcagaacactatatttgtatgatctgtggtgacatccctcatatttctagtattagtaatttgtgtttttaactttttcttgatcaatcttgctaaagttttatcaattttttacctttcaaaataaaacaacttttagctttagtttttttcagttgtccatatttattccattgattagaatattaaatgtattatttttagtttatacctatgattttaaactttttaaaaatatataagcagagtataggctgagcgtggtggctcatgcctataatcccagcactttgggaggccgaggcaggtggatcacgaggtcaggagttcaagaccagcctgaccaacataatgaaaccccatctctactaaaaatacaaaaaattagctgggcatggtggtgggcatctgtaatctcagctactcaggaggctgaagcaggagaatctcttgaacctgggaggcggaggttgcagtgagcagagatcgtgctattgcactccagcccgggcgacagtgcgagactctgtctcaaaaaaaaaaaaaaaagtatgtgtgtgtgtatatatatatatatatatatatatatatatatatatatatatatatatatatattcagagtataaacgcaacttcagagtcattcaacagattttgatgtcttatgtttactttattgcagtttcacttattttctaatttccattgcattttcttctttcactgtaggtcattaacaggtatgttgtcaaatttctacctatttaagacttttctggatatgttaatggtttctaacttaattccatagtagtgagagaacataccctttaagatttcaatctttagaaacgtgttatataaaaaatggttcaccatttgtttcatgttgagtaatattttcatgtgcacttgaaaataaatgtacatttgccagttgttggatgtactgttctacgagtgttcatttaggacaagctagtcatcactcttcttcaaatcttctgtttccttactggtttttaaaaatctagttgttttatctattattgagagaggaatgttaaaatcttcaatgatatgtacagatttttctatttctcttttaagttctgtttatgcttcatttattttgaagctctgttattatttgcataacttatgattctggccgggcatggtggctcacatctatcatcctagcactttgggaggccacaggaggaggatcacttaagcctgggagctcaagaccagcctgggcaagaccccatctctaaaacaattaaaaatttctttaaaattctgattctgtcttcctgatgcattggctttcttaagaaacttccctttttatgtttagttacattcctagtcctgaagtctactttcgctgatatttatattgctttcttatgtttgctgttcgtgtaatatattcttttccattttttaaactttcagtctatttgtatgtttatatttaaactatacctcttattgacagcatatagtgtgggtttgctttttccctagtttccatcttttaattgtaatgtttagttattttatatttaatgtaattaatgtggttgggtttaagataccatttgctccttgttcttcttttcctactttcttgccttctttcgggttaaccaaacattttttagtagagtgctaacaattcctgttaactttttagctatactttcttatattttcaaattcctttataaccttttgaacactactcttttataatttttaagtggatgctctaggaattaaaatatatatccttaatttataaatttatttgtagttaacattgtaatactttatgtaaaatttaagagccttgcaacagtgtaattgcatttatacctttgtgctattattgtaatataattaacatttaatatattataaactccacaatattttatatattttaatatatttttgtataatcacttatcttttaaagaaaatacatacttcttttaaagaataaaaagaataaatacatcttttaaataataaaaaatacatagtccgttttatttaccctcatatttatgatttctgatgcttttgcttctgttttgtagatctgactttatctagcatcatctccctttagcctgaaaaagttcctttagtatttcttatatattaatcttaaaacagattatgtttggttatatgaaagtgtttttaattttgccttcagttttttgaaggatatttttgctggatgtagaattgtgggttgatagggctccccaccccccttcagcattttaatggaagaaattattccattatcttcttgcctctgttgttaccaatgagaaaccagttaccatttatatctttgtttccttgtatgtgacgtgctaccttgcccaagctagtttcaaaattttgtcttaatttttttttagcggtttgactggactttgccagagttggtttctctatatttattctgagtgggatttattgagacactggatctgacagtttatttttcaccaaattttgggaattttctatcattatttccccataatactatttctgccccagtgtctttcgcctctcatcaattacatgcttggtattgccagcagattacagagggcgtgtgtgtgtgtgtgtgtgtgtgtgtgtgtgcgcgcgtgcgtatgtgtgtgtgtatgtgttttccccagattatagtaggggtatgtgtggttgtgtggtttcttttctctttcttcttcagactgggtattattttcatttcaagttcactgacttgtttttctgctgtcacaaatctgttgttaagtctggccagtgaatcttagaatttgctattgaaggatctagctcttgaatttccatttatttctttctcagtttccatttgctgccagtatttctcatgtgtttacccattatatgtatataaatatatatatatatatattttttaaaatctttaaacatatttataatagctactttcacatctttgttaggtgtttccaacacctaaatcatcttgtggtgtgttactgttgactaccttttctcctgatctggagttacattttctaccttctttgcatgtttagtaattttttattgtgtactggatattgtggatgacattgtggattgttatctctttttgaagagtattgatttatcttctagtagacagctaaattactggctggtaaacatacacttaactatacaactcagcaattacagtcctgggcattgaaatgaaaacaaatgcttttacaaaagcctgtacagaaatattcatagcagcttttatttgtaatagccgaaaactaaacacaacccaaatgcactttaaaggacaaatggtgaaaaaaactgtggcacaactgtaccatggagcaataaaaaggaatgaactattgatacgtgcaccaaactggatggatctcaagggcattatgctgagtgaaaaaagccaacttgaaaagattccatgctatatgattcaatttatgtagtattctcaaagtgacaaaaattatagaaatagggaacagattgcagttgtcaagagttaaggaaaggggaaggtggatgtgattataaacagcatgaaacaattcagctgtggtgatgaagcagtgaatctcaattgtggtgtagttatatgtatctgtacatgtgctaaaatgtcatagaattgtaaaaaagacatacaaaaaatgagtgcatgcaaaaactggcaaaattcaagtaaggtctgtaatctagtctactcaatttccagctttcttttagctctgatctacattctttaatgcctcaagccaataagactgtggttttctcctttaaacctagcctctctgcacttaagtgggagtactgggaagagttccgagttcccttccaggagagtctcataagtgtgtatctcacccagtgtaattcctttctttcaatgatcagaacccctacaatttctgtctgccttggtcactttccaatttcttcaaacagttgttttttatattttgtccagagtttataactgttaactgtgggcaaattagttcgatataaggtagttcatcattactagaaccagagctcaactaacatctttttgaagttttacaaacataaaatgtttataaactttttcagttagaaatttgaagacaaaatattataggagtattacataagtaaataattatgtgataactgaaaacatgaaaaaaatcagaatttataagtaggaagaaggataaatatacaaatgcagccagaaacaacttttaaaagacatgtaaatgagtctttcagaagtttacagatagatgcaattatgtattacctaagcagcattctcaaataggagtatatacttaatcaccagaaaggacttaagctgtaaaatgagatctttattcattgtcttttggaaatatttttccatttcactctaaaagttgcatttttttttctttttctagcatatctgacctttattatttattggagaataaaatggcaatctaacgtcccttctgcttttatttttgtctttttattctagttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtaggaattgtagttctatttttaaagagctttgtctctgcaaaagtatggaaggaacatgattacctgttgactgttatcttttatggaaatatgtgtttgatctgggttgcttcaaggttagtgtaaaacaggtgctcacattcctaagtgaaaatgataggaaagttctaggatacactttatgaagctattttagtgtatgtcgaaatcacttatgatgagaccctcaaagtccttactgaattgaaaatggcagcagaaactgtagtaaaccatctccagatttgcttcatatatttctaacatatatccagttaattttatacatatatgcataaaattacataatatatacctatataattataggtatacctgtataatatataggtaattgtaggtatacccatataatatatacctatgtaatttatgtgtatgtagtgtccatatgggcatttttacattgttgctgtttgagtttgtgagctagctgaatagaaccagtatatccgtgaacatactaatgggagcagtagaaaaataaacatgtaccaagccaagacagtagataaaagagttgaagagtgatcagaaactgataaatcagtaagggaaaacttccaggagaaaatttgttaattaatagacttgtaattgaattatacatagataaaaataaaaaattataagcatataactttttatttattatgtactgaacatatttgtgtaaacatcgcctgggttaagaagtagaacaataccaccaccccagaaatcctcttcatccatgtgtcccagctgcacgcccattcacttttaaaggaggcgacagttgtcactatggagagtgatacctgtcaacctagagtgtggggttttatagatcactgaagttaaaggcagtaaaatttagttggccaacaatgcctgtgtttggaattaacaatgagtttggaagttggaggcaaaactctcagttggcagagagctttaatgcaaggactggaggtacaaaattatttaagaagatattcatctaatcttactatctctgcctctttaaaattgcatcagttttggccaggtgctgtggctcacgcctgtaatcccagcactttgggatgctgagacgggtgaattatgaggtcaggagattgagaccatcctggctaacaaggtgaaaccccgtctctactaaaaatacaaaaaaaaaaaaaaaaaattagccaggcgtggtggtgggcgcctgtagtcctagctactcgggaggctgaggcaggagaatggcgaatggcgtgaacctgggaggcggagcttgcagtgagcagagatcgagccactgcactccaacctgggtgacagagcgagactcctctcagaaaaaaaaaaaaaaaaaaaaatttcatcagttgctagagcaaacacaactctttgtttctggcttttattaactgatgatacatttgtatttacacgttgagtgccccatatctgaaatgcttgggactagaagtgttccatattttggattttaaaatatttgcagtatacttatcagctgagcatccgaaatctgaaatcctatatgctcccgtgagcatttcctttgagtatcatcagattgtggagcatatcggattttggacttgggatgctcaacctgtattaatttatgttttctgttgtttccaatcaggactgttggttctccctaaggagcaataaatgaattaagtattctgattaaaaaagaaagttttgctgagtaggatgtattataataaagagaaattttaattaagtaggagagccatctctttaagagttttcaggaaagtaatgttagtacctcgactttatgaaagagaaaggaggagaaaattgatagaataatgcagtgactgaacattagcttggtgtctgtctttcctcattgttcagtgagtgactctaagaaagtcattttcctcattataatgacatttttcatcttttctatttcttcttaacattaaaaacaatttcaaatgtaccaaatagttacaaaattgctagactgaacacctgcatgcccattgcccagtttcaccaattataaacattttatggaatttgctttatctctctctgtatttacttttccttttccccttccccctctaccattacgatgacaatgatgaaccatttgagaaaaagtggtagacaatcatgatccttcactctaaaatatttcctacttaaccacaatataataatcaattcaggaaacaacattttttattgctgttatctaatatatagttcacattaaaattttaccatttgtctgattcacaatcatagattgcatagttgtcacatttgtttggtttcctttaacctggaatagtttattagcttttctttgtttttcatagtagggccttccatgatagtgacattggagaagagtacaggtcagctattttgtacaatggtcctcatttcaggattgtctgtttccacctatttccttcctaaaaaggctgtgataggggatggagattcatggatttttcttttttcttctttcttttttttttttttaatgaaaaggttatcttaaataacaaagtctacaaagagttttcaggataaagtctgttggaacaaaggaaatctagaaactagaatcactaagataatttaggtgttattgaaaggaattatacacacatacacacacacacaaattgtaggacccaagatttataaactttggaacaaaaattagggtttgcaaaagcagaacttttgattttgattgaacagtgcattttattttaaagtccttgacatcttataagaaataattggttttatattataacgtatgatagaaggtaagtcacgattcgctatatgaataactttattttcatgtgatgtttggactaaggatagaaaagattctttgtttatatgtttgagtaccttgtatactacctagtttttagatgtggtatattttaatgtcaccttttctgtaaggctcttactggatatattaaggaaatattttgatgtggaggccaaagcaaaagattggggctatattgatgggttttctatttattagttatgtgactgtaggttagtgatataacttaaagcgtatgcaaattctggaaccagattacctaagaccgatttcttcctctgccgcttaagttgttgagcagattaagtaacttgtccatgcctcagttttctcgtcactaacatggattataatattacctacctgatgttttatgagtaaatgagttagtaaggtttatgagggaattaattaacataggttaggtgcttagaacagtgataggcacatggtaaatcttacataagtgttagtattcattatcatcatcatcagagcataatttattagtatgataaaactgtcaaaatggaaataataatgtatacttcatagggcagttgtgagaaataagtgaattaatgcatataaaacatatattacatgctcaatatatatataatgtcatatcctttagatgcatattaatgggcttacattttaacttgtaaactttttattattttgtttctctcaaattatttgttactattgactttataatgtgaaagtggcaactggaagggtaagcatgcttataccactgaagtggcctatagtcgaaatatttgagaagtactgtactgggtgacaattgcaggggtccttattctaaaaatttaaaagtctgcatctccagtttaaaatgtgtgagcattctttttattgttattattctgtttgttatcataattattattctattgagaaccccggaaaatggaatttgagtttcacttgttccaagttagtctttagctggtcgttgcagcagaaggaatatagctagccacatttagtgttagcattaagaggatattgatgctatttaaccagccatttacatgaaatgcttgggattttttttttcatttttcagtggatatcaataaaatattgccgaatataaatgaatcaagtaagatgacttaggttttaagctggactttacaaaatgcatatcttttctataaatgtggtcagtgaagattggctcatattgtgattttttttttttgagacggtgtctcactgtgtcgcccaggctggagtgcagtgatgcagtctcagctcactgcatcctccgcctcccgggttcaagcagttctcttcctcagccttccaagtagctgggattacaggcatccgccaccacacctggctaatttttgtatttttagtagagacggagtttcaccatgttggccaggctgatctcgaactcctgacctcatgatccacccgccttggcctcctgaagcgctgggattacaggcgtgagcaactgcacccagccctcatattgtgattttatctgtgccctttccctttcaggttgggagggtgaccctgaagttaaccggaggtttgtctgacttaatcattttataacaccctcaaaatacaattccattattttggtcaattattttgactcatttggctctatgactttggtacttcttctaccatataccattaaagaacagattttagtgtatttatttttcttttattggtgtagatatatatatttaactatactgtattctgaaatgggtttctaaaatagttgatcaaaattgaatagcttctgatctgggactgaattctttattttagatattgaagtaattttttgtgtaaatgtagttatttgattttggataatcatttgtggattatctgtatctaatgcagatcttcattttcttttggttctggcttctagctgtttttctgcccactattatctgaatctctgaaagaggttagtaaaaagaggcagacatttaaaattttttttaatttttatttatttattttatttttttaaaaagagacatagtctgtctgtgtagccaagaccacacttgaattcctggctcaaacaattctcccacctcagactcctgagtagttgggattatagacacatgttactgcacccagcaacactgaaatttttatcactcagttttgtctgtgcaaatgacaaagcaaaatgatcatttacttttttaaggctgcttctgctaaactcttataaaactcttttgtacgcctgcaagtaaatattaaatacttatattcttgtttataccagctgaagatagctatagttaggacgactgatttttcctcaagaaataccaacacaaattaaagtggattttggaagacatgtgcagtatacctgcataactctatgtcactcttaagataactggattcatagtttcataaggaaatgttgagttattttgctaatttgttctaataagatagctgccacaaatatgtgatacaatgctattttccctcagtcgtgaatatactaggaatattttaataaggcaaatgtttattcttcatcttaaaattaaattttaaatgaagccaatatgaggaaaatattaggttttaaaactaatttggttttcctttttctatgtatttgttaatagaaaacaaaataaacttttcttttttcaaacttatttgtatttagaaaaattaatgcaaagaaaaaaagcattgtcgcttagtctgtggaataagcttttagtggtaaacacagacgtattaaatatattgtttcaaacattaagatacatttagagggcaagttaccaaatccttgataatgtctttattattagcataataaatttaaaagactgcacaggattctcttttacaaaaagcactataagaaaaatctagtattttatagtagaatatgaaataagattaaatggtgttttgatttttaagaattcattgattgctttgaatccatttatttgattttgctttttattcttggccataatggttaagaacgttggcagtgatttatggtagaagcttaggggagcagggtctcttctctgggccaaggataactaccatctcaatttgggccctggcattgtggattttgagagaacttttgtttccagggatttcaggaaatccctacccattcaattagcttcaaaatatctagtattcaacaaaaattaggaggcatgcaaagaaacaaaaatatttggcccatatacaggaaaaataacaatcagtagtatctgtccctaagggggccagacattggacctattaaagaagaaaaagtagataagttggacttcattaaaattaaaaacttttgttcattaaagaatactgtaaagaaaatgaaaagagaaaccacagaattggagaaaatcatctgtaagtcatatatctgataggggtctaataccccgaatgtaaagcactcttatgactcaataaaaagacaagttaaacccaacccaaaatcctacaactcaatagcaagaaaacatataacccagataaagatcaggcaaaggacctgaaaagatatttctttaaggatgacataaaaatggccaacaagtatatgaaagttgctcaacatcataaaatgatcaaggaaatgtaagtaaaagccactttatcacctcacatctaccagctattaggatagctgttacaagttgagtatcccttatcaaaaatgtttgggggaccaggattgtttgatattttggatttttatggattttagaatatttgcattatacttaccagttgagcatcgaaaatctgaaatgcagaatgctccaatgagcatttcctttgagtgttatgttggcattcaaaaatttttggattttggatcattttaggtttgggatttttagatttgggatgctcaacctgtatcaaaaagacaaaagataacaagtattggcaaaggtgttgagaaaagggaacccatgtacccttttgatgggaacttagaatggagcagccattatgaaaaacagtatagatactcctaaggaaattaacatatgactcagaattaacatatgacccagcaataccttttctgggtatatacccaaaagagatgaaatcagctcataaagctgtctgcactcccatgttcattgcagcattattcacaatagctgagacatggaaacaacctaggggttgctcagtggacaaatagataaagaagttgtaatatatatatgcaatggaatattattcagccattaaaaaggaggagatcctgccatttgccacaacataggtgagcctggaggacattttgctaagtgaaataagtcagacacagaaagaagaatattgcataatctcatttacatgaggcatctttaaaaacaaaggcaaatatacagagatagagaataaaacattgccatagtggggaaaaatgggtaactatgggagatgatggatatgttcatttgttcatttacaataataatataaccatcataatatatataataaccattttactacatatcctcatctcatgacatcatgttgtaaatcataaatatacacagtaaaatttagtttttaaaaaataggcaaaggagctgaatagacacatctccaaataagacatacaaatggccaatgagtgcaagaaaagatgcttggtgtcattagtgattagggaaatagaaatcaaaaccatgagataccatttcacaccctcaaggatggctgtaattttttaaagacaggaaataactctttatttggtgaggttgtggaaaactggaacccttgtacattactggtgggaattttaaatggtgtagttactgtggaaaactggctttgataattcctcaaaaagttaaagagttactgtataacctaacagttccactcctagttaaatactcaagagaattaaaaacatggccacataaaaacttgtacataaatgttcacagcagcattactgataatattcaaaaagtgaaaactacctaaatatccatccactggtgaatggataaacaaaatatggcatctccaaacaatagaatattattcaattattaaaaaggcagtgaaaatcctgaagtccctatccttccttaccacatgagaaagattttggttgtcattgaaatgaacagctaaaatgaaaacttgtttcaaagacccttacgtgtcttaggactccagtttgagaaacatttttttggaaattacctagttcagatctctatttatcatgtttttcctgtgtgatgcccttcatacaactattaacttggggatatttagctctcagagtatccttctcactatatataaatgcttcttcgtgctaactgcctgctaagcatttttaaatatattattagaaatgtttattaactaattggcagggactttttaaaattatgcagttctcagctaaatccaagaaatgaatgacagatttcttatgtagaaatttaaattcaactgaattataaggcacagttctatttctttagccttcacctgtttggtttagtctggtacatttgaacagagataaatgtagtttctagttcctaaaactactctctagagattgcataagattgggtataatttagcaactctttttaaatcaacagggtacttttacttagaaaccttacctctttttaaatagtgatatgcaaattggtttcctgaaaccagcatttattttcttaatgattcttatttaagtaccctgactgcgaaatacaaagccatttcacataaatacaactgtaatagtttttcctcatgagaagttttacattgccttgtttattgtgttttgtaaacaggaagcagttaataccagaatcatactatcagcaaattatgggtgactgtctcatagctcttcagctcttggctcttatttcagtaggccagcctgtctggctgctgttgtttgttgtttgctctccctagccccagaatctcagatatagcagttgtgaatctccagctagtagtctaagggtagtacatatgggaatcttgctttagatccagaggtatttattactcaaaattattcaatctgtgagattgtattattcagatcatgtaactgcagcatggcttgggtttgtagtactgtgaaatatcacgggttgtttttttacaaaataatagatctttactttttcaaaattagaatattccctaatttctagaccaagaaggcagtttgctgtttttttcccattgaaagacaataaggattttaagaaatttcatgtttctcaattataagaaataatttcaaagattttaaaaatatttcagaaaatatttaaccatacaaattaaatatctttgttttagaaatcttaaatgttgtattagtaagataggttaattgtttttaattcatcacctatttatttagtttctctatcctttaggtattgtgttagatattggatatacaataaaaagatctaataactggctttgagttcacaatcccaaaagggagacaaaataattgtaacttatagcacattgtaataaaaaaacataggcccaggattattttgagaacaagtagaatttcagatggataaattcttagatggacataacctaatttcattggaggccgaaaagatgagcagctaaggaaacaaaaaatggcccctgaacatgaagtaagcgttagccaactcttttcttttgaattgggcaaattctaaagtcatgtctttcaacttccttgttcagcattttcttctctcttttgtttctacttttgtagaaaagtttagaattgatgcttcattattacaaatttattgcattatttcatttttgtattactaaattttaaaatacattttatttatatgaaattatatgacttctttacttatgtgaactttggttaatcttatttatgcttctgtgaatctctgcaggaaaacaaggtgtatattttgttagttccagtaatacaatggactgattatttttattttgtgtttgagttttagaatggatggtaacaaaaccatgttggtcttttgactttgttttgtggtggctgttgcaagtctggtatatttgccttgcattggggttgttcatattaaattgtaaattttgcaaaggccaactaggcttctatattttccttattgtgtgttccttcctctccagtcacccccatagaaggtttaataaattgttttttaagacattaatctgtaatgcagttcatctcatttatcattaacagaaatctgaaatttaaaagtatatcattttttatacatgtttaatttgaggtgacagtgggatatccaaatgaaaacatccagttaacaagtggacattcagataccaaattactaagatgagaaagattgtggacattcagataccggattactaagatgagaaagattgtacttactcttcacagaggaagtcttagaataaaagtcaaatcctatcatccttctgttgttaatcctccagtgactgcctcagtcactgggacttagtccttgcaatgacttttaagaccttacatggtatagcctcctattatctctctgaactcgtcacttactcccccatcccccaggttctagccatgctcacctctttcatgtttctcaaaaagcagttatgctcctgctttaaggtccttctacctccccttgccagaagcacccttcttccatttatcattctcttggctgtctctcccttacccccttcttacctttgttcatatctctcactttttcagtgaatcctttcctaattaccttacttgcttcccttccacttccacatacctaagcctctgtttttgctttatttttctccagagtaagtattataacttactttttaattttatgtgttgttgtctctgtcacaatagaatgaaacttaatgaggacagttattttgtaaattttattcactgctctatctctagtgcgtagaacagaggttggcatatggtaagagctcagtaaatatttgcagctaatttaaattggtcttctcccacactgagatcaatttaaagttttttggctagtatttacctttttgtctaatatttacctttgctgagtacatattaccaaggattttatttttaaagtcttttcttgaagttgaaactaaagttaacatatataatctatatgcttgtatatacagatgatatatataacataattttatttatatgtagatcatatagtaatatgcaatacataatacatggcatatataatctatgaacacttgattggactgtcatttagtaattcattcaccagatcctataatagactcacacaataggtgagagcagatgcaaactttatatattatgtttaggagattggatgttgtcctatgggcattgaggatttagtgaagggttttaagtaagagattgacatgattagatatacacttggtagcctactctggtgggtctgcagaggataaacttaaggaggacaagaccggaaacagggagaagctatttgggaagctattttagtagtccagcaaaagagttaaatgagaacctgaattgagatcttggtaaaggagaatatgaagaaaggatggattttggaaatatttaagaagtaatggccgggcatggtggctcacgcctgtaatcccagcactttgggaggccgaggtgggcagatcactaggtcaggagatcgagaccatcctggctaacatggtgaaaccccatctctactaaaaatacaaaaaattagccgggcatggtggcaggtgcctgtagtcccagctactcgggaggctgaggcaggagaatggcgtgaacccgggaggcggagcttgcagtgagctgagatcccgccactgcactccagcctgggcgacagagcgagactccgtctcaaaaaaaaaaaaaaaaaaaaaggaagaagtaaaaactgacatttgcttgcatgcaggatatgagagaagaggctagaatgactgcagtgtaccaactgagacaagaaatacatgagaaggaaataggtttatagagagactttgcccaaggacaggcaggtagtgtttaatccaggatttaaacaaagtttttctggccccaaagcccatgctggttttttgttttgttttgtttttgcttttattattatttttaattgttgcataataattgaacatatttatagggtacagtgtgatactttgatacatgtgtacaatgtgtgtgatcaaatcagagtaattagcatgtccctcacgtcaatcatttttcatttcttcgcattgggaacattcaaaatctactctttttgctattcgaaaataaattgttgttaattatagttacctacaatgctatagaacactagaactaatttctcatatttagctatacttttggatctgttaaacaacctctggctatcctctcctcctcacatccttcccagcctctagtaaccactattctgctatctacttctatgagattaacttctttagtttacacatgagtgagaatatgcagtgtttgtcctgtggctggcttatttcacctagcatgatgccctccaagtttgtccatgttgccatgaataacaagatttcattcttttttgtggctgtctggtatatttcactgtgtatatataccacattttctttacccatatatctgttgatggacacttaggttgatttcatatgttggcttattgtgaatactgccacataaatattggagtgcacatatctcttcaacatactgatttcatttcctttggacatatgcatatttgtaggattgctgtatcagatatatagtagttctatttttagttttttgaagaacctccatgctcttttccaaatggctacgctaatttacattcccactaaaaatgtatacgagttcccttttctcttcatttcttcccggcacggaagcccatccttttaactaccatgttgcagtaggcaaatctagttgactccttatcagggaaatgagaccttgaaaatgatacttaagcagggatgcttttgctgctgtttataggacagattagaagtgagaatgactagaattgagaagcaagattaaaggatcttgcattaatctacaattaggtatttggttccaaatgaggattataactgtatctgggaatgaagaaggaagagacaatcttgttaaggaaaaattagcaggatctgaatgccagttagaaatgagtaaaagagaagaataaaaaattgtaaaattatgatcctaagagttggaaattttcataaatagcacttctaatatggagaaattgaaaatgtgcctttttggttgcatgaaataataagttcatgattaaaatgttagggattatttgtacaccaaaaaatatgacagtcattaatcttcagaaaagggctagaagcagagtcagttttaagactagagaaaagggtttactcagacataccagttaaagccatgtgagagattctcagcattctttataataaagtttttcagtatggctgctaacatacagtgctgtagtttaataatttagaatttaaggaaaagctaaaggttctcccatttaacaagaattttctttccttttataagggtagatggagtaaaagagaatggtgaagtgtgttgtttggcactaataaaatccaaaaggtagtgatgattgtaagaccaaggataggattctgagtttcattagggattatatggagaataatggttgatgagggacagatcagcagggatctttaagtgcagttgctaactggtgcaacatgtgagagacctggctggtgtgctaggcggaatgactttgtgttctctgggatctataccaagatcctaacatagactaaacatttgatctttgttgcctgactacataaacaaaaggttaggagtatagaactcacagcgtacaattcaaaatctaaatctagtttatcactttaacttaattatgtatgtactatttatcttcctatcaatataaaatcccaaaccttatgagtgaaagttattttaaattcttttgaaaagcagcttctaaataataaatgcaaagaataatttctctgactccagttcaacattcggcttctacatttacacgtgaaaatgattattttctctttggaaaaaaaaatctcagtatctatttaattattctaaccatgttttcatcctaattggttgtaacaatttcacaaaggattattaattttattttacagatgtagaaaagaaagtatagaaacactatctgatgacctctgtacttttatgtagatcttcatgtttttatgatggctgtaattatctattcattgatatagcacaatttttagaaattttctaacagaggggagcttccctacctttatttggttggaaaggtcataagggtagatttcttactgttgtccttcctgtttaggtgtgaagtttttcaacatgagtggcctcggggacagttcatccgaccctgctaacccagactcacataagaggaaaggatcgccatgtgacacactggcatcaaggtaggaacactcctcttagtctatttttggcagagctgctttattactttcactgccacttcagagcttttgtttaatctactccaagttcagtggctttctttgagtctttcatactcaccatgttgtcttccttcccccagggtctttgcacatgtttctccctcaatccagcttgcttcctcttgatttcctttagttaacacctactcatccttcagatgccagcttagtcattacatacttaaagagagccttctcttccttccataactgttagatcaagttcctccattcatgtatctgtctcagatgtttttatagccatgatccataattgcagatttttactagtgtgattatttcatgaatttctggcttccccgctagactctaagctgccacttggtaaaggaccttgtttgttcttgctcatcattgtatccttagttcctaaaacagtgtgtggcttatatatagtaagaacacagtaaagatttgtcaaatgaatatataaatctattatacacctttaattgctatcttagaacattatggcattaatggagctaagaaatatcaggattttaaaaaatgattgtgtagttaaatatttggtttgttataaggaatatgaccaccttgaacaggctaaaaggaacctaatgctaaggagaccctcacaaatgccagatagagaagaaacctcaaatgccagataaatttaaatatgcatagttatattcagtcctattaacttttgattagtattgcattacatgaatataccacatttgaaaaatatgtttttctgcagatacataccctagctgctcatttaatattaggttaaaagagcagctagcttcctacctgagagcagcttcctagaatgagtggagattttattccactcatcttctaggatttagaggaaagtttttcaaactccacactattgacatttcgtgtcagataattttttgttgtgggggagctgtcctgtattttgtaggatgtttagcagtatccctgcttctacacaccaaatgtcagtagcatcttagttgtgacaaccaaaaatgtctccaaacattgccaaatgtcccctggggccaggggaaacaaaatcacctctagttgataatcactgatctagagagtaaagctacagaagactcttctgtccttggattacatgctgctttctctcatgggaggaaaaaaaggaggattttaacaggagaatgccagggctccaggctcgagaaagaaaagtgactatttatcttactcagctcagagagctgtcagagagagacaataacctgagtactcataatcacaagtaagtgtccagatgctgggaggaaggttgagatcaagatgcaatctagaagtgtgtcaaaaattaatgctcttgttttatctgtgtataaaatcagtccttaaaggaaaagctaagaataaatatcttttacatttaattttttgtttggggaaattttttaaatatataaaagaatataggcgaagacactatatcatacaacagaatgtaattgataatattttatcatattattattttgttaatatgttatcatatttgcataatcctgtttaaaagtaatacaatattaacaattgatttgtctgcagtattttaatctatttttaataattatgtgtgtattttatatatatacacacacaggtatctgagcaatatagaatattacatttacataatttatgtaatactgtatatattttctatagtatactttttcaacatggattttgaggtttaaatatgcatagatatattcagtcccattaacttttgattagtattgcattacatgaatataccatctttgaaaaatatatttttctacaaatacattccctagagataaacagcctgttacaaattttcaatgttacagccagccctgcagcaaatatcctcacacatatctcctattttatacataaaagtttctttggctgggtacagtggttcactcctgtaatcccagcactttggaaggccgaggcaggtggatcacctgaggtcataagtttgagaccagcctggccaacatagtgaaaacccatctctatttaagaaaaaaaaaaattgccagttgtggtgccgggcatctgtaatcccagttattcagaaggctgaggcaggagaatcacttgaacccgggaggtggaggttgcagtgagccaaaatagtgccactgcactccagcttgggcaacaagagcaaaactccggctcaaaaaaaaaaaagagtttctttaatatctaggtaaatttttatgttcactaggtaagtaccacattgtttttcaaataacaggcattgagaattcctcttttcccacattcttactatcactgttctcttctcatgttaacactttgccagtctaatgggtgtggggttatagtttaaagggcatttccatgatgattagataaactgatcacctttttttggtcttttactcatttatattttcctcctttatgaatttcttggttgtatcttttgcccatgttcctgctgggttgtttgttcttttattttttgtttctaagacttactttaaattttctggttattaaccttttcttgtttataactgatgcaagtatcttctcccaacctgttggttaacattatttatgatgtctcttgacatacagagccataggttttcatgtgtcaagctttttagggtcttgtttaataatttttcttctactctaaggttttaaatgtatttttatatgttttcttctaatacatgtttagggttttaattaatctgaaatttatttttgtgcatggtgtaatatagggacctaattgtatttattgtttttcccagttatcagtaatgacactacccttgactgtttttattccgttacctttattataagtcaagttcctgtatatatagggatctggttctgagctttcttatgataattgccttgatatgtgatgaaacaagacgttcttggttattcttcagatccatccattgtgctgaatcttcttatgtgttttaatggtttatctgtagatgctctgatgtttttgtgtatatagcatcattacaaatataaaagtttcatatcttttttctcttctttagatatcttaaagataattatattcacatttgctttaaaaatatttgaaagtaccatctccttgaggtttataactgaaatatgggcttcagctttaacaaaacaatgtatttgatatggtaaactaaaaatgtataattttgaaactgagtttatgtatgaatgccaccttgtaatgtttctgtctccccaaacagaattgaattctttaatcataaagagcatctgttagacatcagggtattgccagcattgtgcacagatccttggataggagtttctcagcaactgtttggtggagtgagatatctcatatcttcctcctgttacctcttctccattcattcattcttctaggagaatgaggattaaaacgttaatctcaaaagtataggtagctgtgtttatgcttgttgaatatttccaattcaactcaagtacatgttaagtgcgtactcttcagccagcaccatttgcatgatgttttaaggatacaagtgaaatgtgagacatgtttctgtctttagggagcttacaaatctggtcatggcactcattctgcttcttaaatttctgggctccccatgtccctgaaaataaataatcataatcaaaatgatgataatagataacatttactgagctaaaagtatataccaggaactctgccaagcattttacatgtattctcttttttaatataaaaccctggaaagtaatgtcattatcctagttttacagataaggaaatcgaagcttagaaaagttaactttccactaagtgacttgcctagggttgcatggctagtaaatgacaggaagtttgggcctgtgcatttttttttttttctgttaagggacaggatctcattctattgcccaggctggagtggagcagcacagtcataactcactgcagcctccaactcttgggctcaagcaatcctccccactcagcctcctgagtaactaggactacaggcgcacaccatcacgcctggctaatttttttttctttttttttttttagagacagggtcttgttgtgttacccaggctggtcttgaactcctagcctcaagcaatcctcctgcctctgtctcccaaagttctgggattacagatgcgagctgctgtatccagctgaacctgtgcttttaagcagtataccatgcattttatcatggcaagatccctgtgatctgatctggaccacatctcttgcccttttgtttcttatctatagtttagctatactgaactacttatagattcgttaacttggtatcttcactcttactttatacctttgaaaaagctgtttttttctttcaggaagccagcctctccctaccactgagttcatgtatcttgttctctaggtctagatgtacttctatagtattctagtcttgctgcatagtattgtaatggcctgttttcttcattttctgactaattgagagctacatctaatttattcttggatcctctagacacagtagtacatggttatctggcatataataagtataggagtatttgttgagttagctagtttgttgaaggaaaaaaggcatgcacctgagaaattaactcagaatagcattagctagaaggtctgcaatatgaatggtaataaaagggattcgtaaagagagaaatatagttgacccggagtaataaaggaagacttcttttccattaaggtagaatttttttgccatctccagttttgactttgaacatatctgccctcattttatctccttgcttattggttacttcatttcatggtgatttttcctagtctcaatctctagtcattttatagacaccttgccagttcattacttttagcttcttgctttctctatcccctctctgtctgcgtgtcctgcctgttctatcacttttttcttttcctctatactgtcttcaagttctttggttttacacaaaacttaccatcaaaaacatatttgagagttccacgaagagagtccagtttactcgtgttgcagtttagatccatggatttaaatagatcagaactttagactgaatctactacatatatcttatatcaattagtttctctaaggtaaaagtagatgtcttcaaacactgtgaggttgcagagctgaggttccctaaaaccttgtatgtatcaaaatgtatgttactcattttattcatgccttggtatgtaatttgtcaaaatatcttgctgcattttcttgttgtgggagttataaaatacaattttaataactacaattgggaaaactcatcaataatgaaagacttaaaagacaaacgtgatcgtcacagttttaaaatttggttttgttttggtatttgtaatattttgttttgtgtaggtaaatacatttgattagttgattcttttcaacttactatattgttttgtgctattgtttttatagtctttaatattattaagaaaagtaaatggggctgggcttggtagctcacgcctataatcccaacactttgggaggctgagacgggcggatcatgaggtcgagagatcgagaccatcctggccaacatggtgaaaccccgtctctactaaaatacaaaaattagccaggcatggtggcgtgcgcctgtagtcccagctacttgggaggctgaggcagaagaatcacttgaacccgggaggcagaggttgcagtgagccgagattgcgccactgcactgcagcctggcctcacagcaagattccatctcaaaaaaaaaagaaaaagaaaagaaaagtaaatggtatcttaattgttgccaattatgagctctatagcaactgatcttcccctcttctgtcctcttttttctgttacttttatatgtagccaaatgattttgattgctgcttataaaacaaagagctacttgtgaccacttcttcctattatattagtttgatgaaaacaaaatttcaaagtcatacttaactgtctttatatgtattacaaaacaagttgtctgatgacttggctaaataaaccagggctaaagactggaaggcaaaaatgaatcatagtcattcagtacatttggtatatttttttaaaaaggtgctacctgtatgcaccttgttctcattattttgctttaagataaattgtttgattttgtttattgcatttataggaacttacaaatcatttttttttctgtctttttaggacacagctgtatacagaatacattgttcactgtaccttcgtctctaattattattatccttattttgcctttgaatggatacttttttgatgaggatcaactaatggtttaatcataagaattaagagtttatcagagttattggatttctaattataacttgtgaattctattatcgtattctctgcttaatttgtaacagttatttgaaaattcagatttttctatttcaagaagttattcataatataaagtagttccaaatgtaactgctgtgtttattacttgtttgcttttactatctagtaattgttatttgaaaatattcaagatgtatatatgattggggaaatacatctgttatagcagtcaatttactttatatattttagccagaattgttttctaaattttggtattttgtaatgtccactttttagatgtgaatttatatcactttctaaatctggttttatattttcgataaaaataaagatctcactaaatgtgtaagcatagatacttgatcagagaaggaaatatggtgatacaaatgtacactaactggattttctttgtgtaacagcacggaaaagaggcgcagggagcaagaaaataaatatttagaagaactagctgagttactgtctgccaacattagtgacattgacagcttgagtgtaaaaccagacaaatgcaagattttgaagaaaacagtcgatcagatacagctaatgaagagaatggaacaaggtaaaaaagaaaaagaaaacccatggctgtgtgctttgttattaagacatttataatatgtgattttactttattattattattattattattttattattattattattttttgagatgaagtcccgctctgtcgcccaggctggagtgcagtggtgcgatctcggctcactgcaagctccacctcctgggttcacaccattctcctgcctcagcctcccaagtagctgggactacaggcgcctgccactatacctggctgatctttttgtatttttttagtagagacggggtttcaccatgttagccaggatggtctcaatctcctgacctcgtgatccgcccacctcagcctcccaaagtgctgggattacaggcgtgagccaccgcacctggcctacttttttattattaaaaaattatattgaacattataattttataaagaaatgtctttgttaagatgctgtttattttagaaagtgaacctgagaatcttcttgttataacaaagtgtcttattaagttaactcaaaaactggttgctttaggagattatgggactcagtatcataggggattgagtcagaagacacaagttgtggagttggacctgaggccctagcatagagttctttaggacagtaactccatgaagagaaaaatctccacttatatgaggaagtttgtctctacctgggctcttctctgaaaaaacccggattttttttttttttgagatggatcctcattctgtcacaggctggagtgcagtggtgcgatctctgctcgctgcaacctctacctcctgggttcaagcaattctcctgcctcagcctcccaagtagctgggattacaagtgcgcgccactatgcccagctaatttttgtatttttagtagagatggggttgcaccatgttggccaggctggtgtatttttaagcttcatatttttactacctatatttactggaaccccataccatcaaactccttggttgcctaccagaaataaaggcaaagcactttgaagaaacaatcccacaagctggccccatgggagtgccacagaaaaagtgcttctgagggtgattttacactgcaaagttatttaacatatgaggaaataatctagagtaacagcacaaataacaaacagaaggactaaccccaaagaacttcagattattagcattaaagttttataattttaagattttagaagctggaaaacagatagtctagtgacaactgatttagcaaacaggagaaaccgtactgtaaaactgcagagaggagcactagcaagaggctctctgccccttccctgcttggtctcgaaacactaacagcctggctcctactccctaaattgggggtggcagtatacctctgggtaaactgagcagtcggaagatgaagtcatgtgggggtgatcctcaaatgaaaaaattcattccttatcttgcccccactcctcacctaactgccagtcaactatttaatgtgaacaaaaagccaggtattgggggaaagcctgtaatataaaagagagcaaaccaagcaaacaaacagaaaaaagggaactcagaggaagcagaaacagtgcagggaactgaagaaaacttaaaaagataccagtccctgggagacatgagggaaggtatttcatcaaaagatgagaataagtcctataaaatgaaatattcaaaagaagaaatagcttttggaacttagaaacaggatagctggaaaaaattttacttctttacctttgtttcctcacactctctgccctgaccagtggcaggcacactctgcccctgctatttacagttgctgttccttctgtctggaatgctctgtctctagatatccacatgctttattcacctctttcatgtctttgctcaaatacgtcttctgagtaaagttgttcctaactaacctatttgaaatatttttaaaaacagaaaaaaaaatctatgcatctttttataccttccttattttccccacagtactttttacatctgacatatgacatactttatatattatttgcctgcccccactagagttccacgagggcaagcgattttgtttgttcacgactatatcctcagtacctaaaacagcacttggctacatagtaggctttcaatgcatatttgttgaatgactggatgaagggatgtgatttgaagaaatctcttagataataagcaatggaaaatgagagaaaaaataagaaacttataggattagttcaggaagtctaacatatgattaatcccagaaaaagagaatagaacaaatggaagggaataaatgataagagaaataatgcaaaaataatgttctcagaactagaagtatattagtttccggattgaaagccctcatgtagtgcccagcacagttgttgtaaaagaaagataaagtaacttataccaatgcacaatttagtgacatttcagaacaccagggagataaacaagagagaagaaaaaacaggtctcacacatactagattgctttcagaataggttcagatttctaaataacaacattgaaaactagaattctagacccagaattctgtgttcatccagttgaagttatgagtgccaaatagacatgctcagacattcagagtctcaaaggtattacctccagttatacctgtttcagaaatctctatccaatccaagatagtaaagctagaaagaagggcataggatcttaatccagggaaaccatggaatcttaacacaaagaaaggtaaaaggagacccaggattacagttgtgcagcaacctagaaaatagccagtcctagttggagcaggtggatagaggactctagggaacatttccatagggaaaaaaaaaaggaacgcataagagtatctgctaactgactgaatcgagatgaatttttcagctctggaggggagtttagggttgaattaaactatacgtaagatctgaaacactaaatataaaaaaagaaatgtaagttataacacacacatcggctcccttataaagtatatttatatgaccctagtgacatatatattaaatattggttacgcaaaaaattgttaaaactatactgaaagtaagagaggaggggtaatttgtatagcaggttggtgtaaataaattatttacctttcatggtagcatgtcagtaggttatgtctaacatggacaaaatcaggttatagcaaattagcatgttactaagaaatataaagcatattaggatataggctaggttagtataacaacacacccaaaatacaatggttttaaaaagatggtctaggaaggtgtgagggattgactccttccatctttttggctctgccattcctagggtattgccattatccatgttgttagacatggcccccttgtccatgtcccagctaacaagaaggagaaagaaaaaaacaagaaggcatgcttcttttccattacagataagacccagaaattgcatgtcacttctgttcacgttccgttaggccagaaactagtcacatagccattcctaccttaggttttccctaaaatgttagatattttgcacgtcacacaaaattatttaatctacttgaacttgatagtttgttttttagaacttgcttacaaacaaaatcctttcttaccctcatgtaataaaacacatgaaataatgaaggaaatgtatcttaaaatgagaaactcctgcaccataataataaaaagataacataatttaaaaataaagaccctgaatagacatttctccaaagaaaatgtacaaatggccaacaagcacatgaaaaagatgcccaatatcattagccattagggaaatgcaaactagaatcaaagtcacataccatttcacactcactaagatggctataatcaaaaagataaggctgggtgctgtggctcacgcctgtaatcccagcactttgggaggccaaggtgagaagatcgcttgagcccaggagtttgagaccagcctggacaacatagcaagaccctctgtctacaaaaaaataaaaaattacccaggcacagtggtgcatccctgtagtcccaactattcgggagaccaaggtgggaggattgcttgagcctaggagtttgaggttgcaatgagctgtgattgtgccactgcactccatcctcagcaacagagcaaggagtgtcttaggaaaaaaaacagaaaaaggtaataacaagtgtgggtgagaaattgaaagccacacatacttctgatgggaatggaaaatgatggagccacgttggaaaacagtccaacagtttctcaactggaggagagtttggggttgaacatagagctagctatcatatgacccaataattccagttctaggtgtatccccaagagaaatgaaaacctgtccatacaaaaaatttgtacatgaatgttcacaaaaacattatcacaaatagctgaaaagtagaaactacccatacgtccatcagctgatgaatagatatataaaaggacatataccactatgaaggactattattaggcaataaaaaggaataaagtactgataaataattcaacatggttgaaccctgaaaacatgctaagccaaagaagaagccgagtcacatatgaccacatattgtatgattccatttataggaaatgtccaaaaaaggcaaattcattgagacaaaaaataaattggtagatgcctcagacttaggggtattggaaaaatggggagtgactggtaatgggaatggagttttttgggaggtgatgagaatattctaaaattggttgtgacagtggttgcacaattctgtgaatatactaaaaatcattgaattgtgtgccttaaatgagttaattgcgtgttgtgtaaattatagctcaagaaagccattattataaatagtatgtgagataacattttacaccataggtttgcaaaaattaaaaactatgatattgtttttcagtgaggatgcagaagagcaaaaccaatgttacaacctctttggagagcagtttgtcaatacctagtgatataagttacgcagaccttatgatcctgaaatttcactctagtatttatcctgaagaaactgtgacatgtgtacaaaagaggaaataccaaaaatagtttattatagcactgtagttatcaaaagacctaccagtaggggaatagaaatccactgcagattatttatataatataatactcttaacagcagttaaaatgaatgaatcaaacctacatgtatcaatgtggttaaatctcaaacataatattgagtggaaaaagtaagttgaaaaagtttgtacaattgtcccttggtatgtgtgggggattggttccatgacctcccactgatactaaaatctgagtatgctcaagtccctgatataaaatggtgtagtagccaggggcagtggtgcatgtctgtaatcccagctacctggaaggctgaggctagaagattgcttgaatttaggagtttagggctagcctgggcaacatagcaagatccctgtctcttaaaataaaataaaacaagcaaaatttaaaaataagataaaatgtcatagtatttgcttataattgatcctgtcatgtacttttttaagagagggtctcactctgtcacccaggctggagtgcagttgcgggatctcggctcactgcaacctctgcctcccaggtccaagcaattattgtacctcagcctcctgagtagctgagattacagacatgtgccaccacgcccggctaatttttgtatttttattagagataggatttcaccatgttggccaggctggtctccaactcctgacctcagatgatctgcccatctgatcatcttcccaaagtgctgggattacagacgtgagccaccttgcctggcccatgtacttttaaataatctctacattacctattaaaatacttactacaatgtaaaggctatgtaaatagttgttgtactgtattgtttagggaataatgatgaaaaaatctatatgtattcagcacagacacaattcattttcaaatatttttgatctgtggtcagtagaatccatggatgtggaggactaatggtatatataactatacatttatgtaaaccttaaaacatgaaacaataacattgtttatatatatgtttatatatataacaatatattgtttatgaaatcatacatatgtagtaaaagtataaaaaaatgcttaaaatgattatggcaacctcagaataatggttacttctgaaaaaagggacagaggagggagggcagggctttctctgtatttgcaacatgtatttatttaaaaaggaaagatctgaggcaaatgacgttaacatctgtgaataccgaatggtggctatattaatatgtgctgtataattttctgtattttttggaatacttgaaatccttcttcttgtttttgagacatggtctcatcctgacacccaggctggagtgcagtggcacaattatagcccaccgctgcctcaaattcttgggcttaagcgatcctcctacctcaccctcctgagtagctaggattacaagcatgcaccaccacacctagctaatttttaaaattttttgtaaaaataaaggactcgctatgttgcccaggctgttctcaaactcctggcctcaagcagtcctcccacctctgcctcccaaagcactgagattacaggcttggggcactgcacccaacccggaaatacttcctgttttaaagtgaaaatatgaatttctgtgctcaataataccatatttggcttttggttaactagtctgacagatcagaaacttttattatttaaatatgattctgctttaagatgatgggatatgcaacatcacctcacaaaagaactcccaattacttagcagtttcagttttatcaatcagagcatcatggcacgaatgtgaaatgttagtgagttcatgcaggctctcaaaaggaaaaatcatattttcattctctcttcaatggcacttgatcaaatcagaaaaagaaagagaaaacttgaaataatttttcttttacaacttacccatttctcaaaacttctggtatggactttttaaaaaggcaatatatttatagcatttttctcattgttgaaacactggatgtagtattcaaatgttcatgctaccatgtattagttgtatgttttcaggcacattacttaacctttgtgatgttccattttatgatccataaaatgagtataattaagattagtgtgaaagtgcctagatactgactaaatgttatttgaatttgaaatttggtggatctatgtcttcgtaaacttgactttatggaaataagctcttttcagatatgtgatttttttaagtttctttattatagagaaatcaacaactgatgacgatgtacagaaatcagacatctcatcaagtagtcaaggagtgatagaaaaggaatccttgggacctcttcttttggaggtaggtgtcttcattgactcagaaagtgattaaaatctttgttgtagccagtttggttttttcttttttaaatgccttatatccagttaataaattataaaacaaagtaaagaactttttataattattttattatgagaactatttgacagttgttactgtttcagaatcaaaagtgaataatgaacatgagaaattttcatgaaggcattctaagcagtgagatggaaaacttgaagcttattatatggctttgccttttatttctgtggtggttaggcctagttgggaaaataaaatattaatattagatttacttagctagctagtgttatctatatgtataccatagaattttacttttgaatgaaggatcccacagtttattgcagtacgtgattttctgcagttttctgaataaaaatgtttaaattgtttatataaacattctaagagaattactattttaactgtcaaactttgtaatgtgaagaacttttaaatttgaatggctttgtaattactgtgtaattttcacccctgcattttctatctaatctttactccctgcattctcaatatagatgtcttgtttccaagcatcctcattactttaaatgctttctctcctacatgaatgtttaaagacatatgtatgtatgtgtgtgtgtgtgtgtgtgtgtgtgtgtatatatttctatctctaggtctaattatatatacttatttatggcccttgggtacccctttttttttttttgagacggagtctcgctttgtggcccatgctggagtgcagtggtgtggtctcggttcactgcaagctccgcctccccggttcatgacattctcctgcctcagcctcctgagtagctgggactacaggcgcctgctaccacgcctggctaatttttttgtatttttagtagagacggtgtttcaccgtgttagccaggatggtctcgatctcctgacgtcgtgatccgcccacctcggcctcccaaagtgctgggattacaggcgtgagccactgcgcccggcctatttctctttttaaaaatataaaataaaggtagcacgggtaaagaatgaaggtactagaagaaattttcgcacatctaatgagagggtaatattataatgtatttattcaacaaagatttgttgaatacctacagtgtgttagacactggatatctacatcatggaattattttaaaaattaagtgacacaatttcttagcagagtactttatacatagttagtactcattaagtccagtatgggcatttttttttaagctcatttcctccctttgctgtctaaaattcctctgcctgctggtcagagttctgcattatctgactctaaccctcctgtttccattggtccataagaaaactgcttcagagaggtctcactatatcttgcacatgcattctagcttccttaacttgctttgcaccattccctacatttctttgtggcttttgacacttactgaccactcattcccactaccttacacattccatggcccctttcacagtgttctttctctacccctctggttactcctcagcctttttctcagatttctttccttaattgcctcttaaatgttagtatcccctgggagtctagccttggctctttcccttttttaattctgtgcacatttactgggaaggtttatctgtgtctttgtctatataacatatacacatatatgtgaattacatatatgaaatcagttgcatttctctgatttgaagcaatagaaatcaactctgactaagcaaatatgaatttattggaatgctatttggatatcatagaaccatgcttggaaatgggatgaaatcaaaatatcttaaggaggctagaaaccaaaagctttgttaatggtctcttagaaagaaccatctgggcagtgccctgctgctagaatgagtgtactcctgctatgtttagctttttgtaattattctcaagattcacatttgaggaggaagtctcccaatggcctgattaagaatcccataaggctttgtgtagtggggaagaaaatttcccagaggaaatccgagtattctttactaggggaaaagatgatcgtagttaaaaacaaataaacagtccgggcgcggtgcatcacgcctataatcccagcactttgggaagccaaggcgggtggatcacttgaggtcaggagttcaagagcagcctggccaagatggcaaaatcccatctctactaaaaatataaaaattagccaggcatggtggtgagcgcctgtaatcccagctactcaggaggctgaggcaggagaatcacgtgaacctgtgaggcagaggttgcagtgagctgagattgcaccattgcactccagcctgcgcaacagagtgagactctgtctcaaaataaataaattaataaataagtaaaaaataaacaagagacccaaatgattactatatgtacctgtgaatcacaaaggtctatccttagcccagatctgtcttccaagcttctctttcaatacatcctgctgccttttaaagatttccaattttcctagagtggcctcactttggaggttggaggtattttggggtttctcagcagacttctgtggcagtggggtcacctcaagttttggaacagcaatgaaaaatgaccagtgctatgataacatccagtttactcatgtgacctgggatagttccttttgtactatccgtcccagatttgttgccataatcatagacatgacttggggaggagagttgcttgtgctcccttttcataagcattctggaaagaaatcaaaacttggatgtggtgctcactttggcagcacatatactaaaataggaacaatacagagaagattatcatggcctctgcacaaagatgacacataaatttgtgaagtatttcatatttttcagctgaacccaacttataccacaggcaaaaccaagggcatcaaagaatataaaagcaaaaagctccattgaaaggacagcacctttgaacattaaaggagcatcagatgcgaaagaaccagtaagaactctggaaacgcaaaaagccagagtgttttcttaacctccaaacaactgcactaactccccagccatggtttgtaaccaggctgaaatgactcaaatgacagactaagaattcagaatctggatggcaacaaagatcattgagattcaggagaaagttgaaacccaatccaaggaatcttaggaatccagtaaaatgatattagagattaaagataaaacaggtattttaagaaagaaccaaactgatctgataaaactgaaaaactcactacaagaaaaatttcataattggaaatattaatgacagaatcgaccaagctgaggaaggaatctcagagctcgaagaccagttaactggtcaactcagaaataaagaaaaaagaataaaaaagaatgaacaaaacctctgagaaatatgtgattatgtaaagagactaaacctacagctggtatccctgacaaacagggagagtatattagtcagttttcacactgctataaagaatacctgatttggggccaggcatggtggctcacacctgtaatcccagcactttgggaggccacggcaggcggatcacttgaggtcaggagtttgagaccagcctggccaacatggtgaaaccccgtctcaactaaaaatacaaaaatcagcctggcatggtggcacatgcctgtaatcccagctactcaggaggctgacacaggagaatctcttgaacccgggaggcagaggttccagtgagccaagatcacgccactgcactccagcctgggtgacagagcaagaccctgtctcaaaaacaaaaaaacaaacaaacaaaaaaaacaaacctgagactgggtaatttataaaggaaagagggatgtttttgtttggttggttggttttgttttttgagagagtcttggtctgtcacccaggctggaatgcagtgacacaatctcggattactgtaacctccacctcttgggtttaagcaattcttgtgcctcagcctcccaagtacctgggactacaggcatgtaccaccatgcccggctaatttttgtatttttagtagaaatggggtttcgccatgttggccagtctggtctcgaactcctggcctcacatgatccaccccggttggcctcccaaagtgctgggattacaggcataagttaccatgcctggctggaaagaggtttaattgacttacagttccacatggctagggaagcctcaggaaatttacaattacagcagaaggcaaaggagaagcaagtatgttcttcaccaggcggcaggaaagagaaagagtgagagaatgaggatgtgccacacttttttttttcttcaacttttaagttccggggtacatgtgtaggatgtgcaggtttgttacatagctaaatgtgtgccatggtagtttgctgcatagatcaacccatcacctaggtattaagcccagcatccattagctattcttcctcatactccccctcctgccacccctgcccccaacaggcctcagtgtgtgttgttccctctgccatgtgtccatgtgttctcattgttcagctcccacttataagtgagaacatgcagcatttggtttgatgttcctgcattaatttgctgagaataacagcttccaactccatccatgtccctgcaaaggaccatgatctcatccctttttatggctacatagtattccatggtgtatatgtaccacattttctttatccagtctatcattgatgggcatttaggttgattccaggcctttgctattgtgaatagtgctgtgatgaacatacatgtgcatgtatctttataacagaatgatttatgtctctttggatatatactcagtaatgggattgctgggtcatatggtatttctgcctctaaatctttgaggaatcaccacactgccttccacaatggttaaactaatttatactcccaccaacagtgtaaaagcattcctttttctctgcaaccttgccagcatctattgttttttgactttttaataatcaccactctgactggcatgaaatggtatctcattgtggttttgatttgcatctctctaatgatcagtgatgttgagcttttgatatgtttgttggctgcatgaatgttttcttttgagaagtgtctgttcatgccatttgcctgctttttaatggggttgtttggttttttcttgtaaatttgtttaagttccttgtagactggatattagacctttgtcagatggatagattgcaaaaattttatcccattctttaggttgttcactctgatgatagtttcttttgctgtgcagaagctcttgagtttaattagatcctatttgttaatttttgcttttgttgcagttgcttttggcattttcatcatgaaatctctgcccgtgcctatgtactgaatggtattgcctagatattcttctagggtttttatagttttgggtgatgtcttttattcccggaactttgtcccatcacagtcactttggtagtctcatttaaagccagggccctgtgagaagccttggctaatgtgaacccttccgtgtgacacacggtggtcttcttcaaaggatgacatcctgggcagagtttggaaaagttctcagattgattactgaatgcataggcatttgttgtcttctctgtatgcagtacaacataaaaccagctgtcaggacttggaggaataggaagattcctttccaggagcacactttgaagttaattagataaacaacatatgagggaaacttgtagaacaagaacaagtaataacagattatattaaccagatatacttttagaaaatagagatgcttctatattcataggaatagtctcaaaaattattccctgaaatgttactagtctcttgagggtggaattctggcaggtcttccactatcaacctcatttttacattttaatctttataagtatatatttataatacaaagcaagttaaattgtatttacactgatgcaaagaacatttttaaagaagtttcaggtctatttttgaaaaataaatctgtttttaaattatttctatttttatataaacttcaaggtaagtaaatggacattgatcacctattatgagatttatagctaatctaaggggttttataaacccaatttagatatgagtgtactttcctgtgctcatctaaacccaaaatattttaaaaaagagtttatctagtgttgagattttaaagattattaatcacgtccctatctcctttgcattatggactaagtaagtcacggcgatcgggtagaataaaaatagctttattcctttttgttcttgctaaagaaaatattagcaatattttaaatgagaacaatgggttgtgcttcaatcttgttttaaatcttggttatattctttgtgatggagtgataatggagatgtattactaaatttcatttattttaatatttggtttaaataatcttgtccattcatctgttggcagacacttagcttgatcctcatatcttggctattgtgaataatgctgcagtgaacatgggagtgcagacatctctttgacatactgatttcatttcctttggatatatacccagtactgggattactggatcatatggtagttctatttttaattttttgaggaacctccctactacttcccataatagatgttctcttttcttcacatcctcacctacgcttaacagatatgaagtgatatctcatcgtggttttaatttgcatcaacctaagtgtccaaaaatggatgaatggattaagaaaatgctgtgtatacacagagcggaatactattcagcctttaaaaaggaaatcctgtcatctgccacaatatgtatgaacctagaagacattatgttaattaaaagccagacgcagaaagacagataccacatgatctcacttatatgtgggatctaaaaaagtcaaactcataggagagagtagaatggtggttaccaggggctgcgtgaagggttggggggattggagggatgttggtcaaaagatgaaaacctttcaattagatgggaagaataagttcaagagatctattgaacattatggtgactgtaattaataacaattattttatacctgaaaattgcaaagagagagcttttaagtgttttcaccacaaaaaaaatgataagtatatgaggtagtgcttatgttcattagcttgatttggccattctacaatgtatacatatttgaaaacatataccataaatatatattagtttttctcaattaaaaaacaatcatcttagctgaaaaatgcacctctcaaaaataaggtagaggcaaatggaaaagtatatcattggatgtgtttactaaattacgatagtcatttttaaatcctacccacaaactgtgcagaggtttttattgaccttccagtttccttgattttaaaaaaaatgattcttccaaacatcagaagatgttgcattttcacataaaaaaaaaaaaaaatagggctgggcatggaggcccatgcctgtaatcccagcactttgggaggccaaggtaggtggatcacctgaggtcaggagtttaagaccaacctggccaacatggtaaaaccccatctctactaaaaatacagaaatcagcggggcatggtggcacatgcctgtaatcccagctacgtgggaggctgaagcaggagtatcacttgaatccaggaagcagaggttgcagtgggccaagattgtgccactgcactctctcaaaaaaaaggaaaagaaaaaaagggccaaagcccactgagaatctaattggaagatttttcaacagaaaatgctctaagattttaaactgatgagataagataaattatacaagctattcaggtcattttcagtatcacgtcattttcagtgtcacgacattttcagtatcacgtcattttcaggaacaaaattgtaacagtggtaacacttccaaacatccattttcacatgctatctctatagcattagtgtctttttaaaaagcagtttactttttattcattgttaaaatttcatcttaatcctgaaggaaaaaaaatttgtttactttttggagagtatctgctagacagcaaacttggtaccctggccttttttttttttttgagacggagtcttggagtcttgctctgtcgcccaggctggagtgcagtggcgcgatctcggctcactgcaagctccgcctcccgggttcacaccgttctcctgcctcagcctcccaagtaactgggactacaggcgtccgctaccacacttggctaattttttgtatttttagtagagacggggtttcaccatgttggccaggatggtctccatctcttgacctcgtgatccacccgcctcagcctcccaaaatgctgggattacaggcgtgagacactgcgcccggccccgtggccttttttaaaaggaaaaatgagtaacccgtcagcattgttagataggtcttttaatttcgccgtagataaccagcagaccctgtatgatccaaaggatttttatggtcattttacattttgttacaaaattctgtaaatgttctattttttcaggatcttgattttattgcttatatatattctgcagcaagtaagctgcaacatgttgcaataaatgaaaagattacaaataagtaaggtgccacagtcaacctctgcattctggctcttcctcgggataccagggtttgtgtgatatgtgactgtctgcaccgagtcaggcaccatagtgttaatatgcttaagcttcatgtctttattatgttttagattacaatatacatagaggttctaacttttcccgtgctcccttgtggatattatatgccccgtaggacgcatatgtcttcttttggagacccctggctccatctcagtgcataggaagcccctgtgatttggctcctgtccacgtctgctgactcgccttgtaccatatactccagcagctgcaaactgcctgttcgttttctttttgtgctatgctctctccacttcctggaatgttcttccttcaatcctcttcctccccaactatgccttttatatgttaggtaggggtctgtacctttctttgacccccaccctgatcccaaattaggcatccttctgtgtgcttatggactattttgtgtatgtctctgatctgcattttatcactgatattttattatgtttatgtctctctctcctgcgtatcacaatttccttgaggacagagaccaggtcttgacatatatttctgatctcttttttaatagaaaaatgtatagtttaatttttcttttatctttcaacctccaaaccatttttttcttttggttttgcaggctttggatggatttttctttgttgtgaactgtgaagggagaattgtatttgtgtcagagaatgtaaccagctacttaggttacaatcaggaggaattaatgaatacgagcgtctacagcatactgcacgtgggggatcatgcagaatttgtgaagaatctgctaccaaaatcactaggtaaacagaaatgtgtttttaaaaagaatactagctctctgtatcttctccttatataatatgtataatatgtgattattatatttataatacacagtattatatatgttataatatgtgtttaaaatattttttcagtgtggtttcagtctcagatataaatatgaaggggagtttcatcaaatagctgatggagagtattcctttcagcttcttcctttatactgtgtgaattgttttcaattttgattatgttcaagaaagagacaaatgtgtatcctttccattaccctgctcacagaaaaaagaatagaaatgagaaagagagggagtgagaaggagggaagaaggaaagaatatatgtcatatatctactaaaattaatgtttttagacttaagtgctttaactgaggaattccaagtatggttggatgggctattcgctgctgaggagcctagctgagaggatggatggagtctaatttctagtgtctgttctattcactgaaccctgtgccttggggcagggctgggaccttaggagttaggggactttttctaattcttgtaaaggcatggatggactaacagcaagcctttgtttacttcttgaattttcaggctcctctaaagtttttcagtgctcaagttctagttactcctggtgattgcattgctacctttacatctgagtgggggtgtttttcaatagtcagtgtatattttgtagataaataagaaagttttcatattacatttcagattccattccattttagattttttgttactttttttccccatagtttatttgttcagtgagctctgaaataaaagcgatttaaaatgcagataaatttaccacacatcagtttttcagacagatactgtgtgataaagtatctgagttggagagttaagactctaccataccgtttagtatgggaactgaggcatgtggtcagggaagtcaaacaatgtaagattcccctgatgtcactataggtaatacttaattaagatttctttccttggccatggactgtagattcttttgctctactgttcacaaattttgaggactactggtgtatggattgaactgagctattgcattttattttgtatcaaaaaaactaatttaattttagtctcatgttgggtaacaagatatttgttgggtttagcagccttcctggttggaaagaggcctacagtcacagaaaacaaggatgagctgttttctgactcctgaagaacgggcttattgtttgtggaagggccacattacctgttctgcctggttctcaggatgctgtagatctatgactatttgggttcccccaaatcactgccagtagataaatttggagggagtgtcatctactagcttatgtgcttgctagtggtgctgctcccggctgcttacaagacagtgatcctcagctggcctgacaattcattgttgcctctctgagcagcctttcacaatagggaggaatgtgaagtttttgctacagagatatctttctctcattcccccaataatggaagaacagaaacattgaaaaaatactactactttcttatacaatagtgtagagaagcaaagatagggcaagctcagtaataatagaatagatcacctaatcttacagtgttggttgatcatccattagaaaccaatgagatggtcccaccaaaagaataaaggccaactacactaacttagaaaagccaatagcttctttcaaggtatttccaaaaagcatttaggagaaaataaattatagtacctatatttaaacctttattattagaataatcaaagtattagaaaattaaggaaagagaccaagtagaatcattttatgtgtaattcattatcaaccactggggaaaaaaatcaaatcaagattcagaacctatcaagaaagaaatttgaagaaaaatttaggatcattatttatatatatatattcaccttatatacatatatcacatatacatgattcaaagcactgccttcttattttttgatttgttctttccaaggagaaattttgaagaaaaaagttaaagtcaaacttttaaaattgcttttgaatttacagatttagaagatttcagtgtctaaaatctgtactttttaagcataacattttatttataagaaacaaaatctgaatgctgggaagctggtatggtgagaaattttgtccaaaagaacaagtatacatggatatacttatacttgcacagatggttataaaaagattatattgtgaaaggctaagattacaaagaatgagatgttagtgaacatagacttatttgtgaaattctaataaattggaacttgaagtttgaaaaaaaattttaaaaagcaagtcgttataaattcataccatttatatctcaaatgatggagacacgatagtgcttaagagcatagcctttctggtataaaatagaaatggctgtgtctgactctgctacttaattagcagcgtgaccttgaacaagacacttgaccccctctaggcctcatcgttggtaggaaggttaaagggtaagtgttgcttagcatatttcctggctggtattaaattctttttgttttagctgttattattcctgtgactggctttatctaaatgttttggagcttttaatttctgaatgatagatctacaattattattaacaactactagctggttttgattatgcttttatcttagaaatcaatgtgaaggaaggacaatcttgtcctttcatagtgtgctcttagaagcacatagaaattattctgtagaaattgaggcaaatttttttatagatcacattcagtaggatagttccgtttttcttatttctttatattttgagacagagtttcactcttgtcacccaggctggagtgcgatggcatgatctcagctcactgcaacctccgcctcctgggttcaagcaattttcctgcctcagcctcctgagtagctgggattacatgtgcccaccaccacgcccagctaatctttgtatttttagtagagacaggggtttcaccatgttggccaggctggtctcgatctcctgatctcaggtgatctgcctgcctcagcctctcaaagtgctgggattacaggagtcagccaccacgcctgaccctgttcttcttttttgaattgtagctaaactgctacttcttcctgtacagggggcttttgttagtaattttttaatactttgggtttgttttactaggttttttaaacattatcaggggcatttatccttttaaagaggaatcatatggtgagttaagaaaggacttgcatgaagattaggcatgctgctttctagctagataatgtaaactacctcctcccacacacaaaatactgaattttgtcagaagctttgtacctctagtatagatctatcctcttatttccattccacagagtattcaggaccttatgtgagtgatgctgttgtctttttgcataaatatgtagctcagtgcctactgtttaaaagaagatttaggttcaaaaaagttttgtcatggtaacctattagtagttcagttaacttaaaaaaatcgaattaatcttgtgaaatcagggtatctagaaagatcacctaaaatatttagcagcttatatttgaggggcctataagtttggaattgaacttgctgttaattattgttgttgttttaagaagataatgatagttgacatgtaaattattaccagaatgactttagtttctttagttttggtgattatttttcaacttttttttttcacatctcagaaagtgttttgtacaacttagatatactgaccaccataacaggtcatgaaattaaacttcaaggaagcgcctttctcctcttcatcactgtatgctcttctcttggctccttatttcctaaccattcctccttaattcctaaccgtaattcctacctaccttaattaaggtaggaattggcctaccttaattcctaaccattcctccacctcttttccttttctctaccttctttccttttacctgaactgagtgtgattagatatttagctcttcttctagtaacattccgcaagtagctttctttgtagacaccttcagaaagctgaaactgtccctgataaccgaatagatcaggataaacattatctaagccaagctataaacaaaaatgtaaagcctttttttttttaacttttattttagattcagtggtacatgtgcaaggtttgttatataggtaaactcatgtcatgggggtttgttgtacagattatttcatcacccagtgtattagtccattttcacactgcgataaagaacttccctgagactggggtaatttataaaggaaagaggtttaattgactcacagttccacatggctggggaggcctcagaaaacttacaatcatgagagaagaggaagcaattgccttcttcacaaggaggcaggagagagagagagcaaaggaggaacttccagacgcttataaaaccatcagatctcttgagaactcaccatcacgagaacagcatggggggagctgcccccatgatccattcacctctctccctcaacacatgtggattacaggtccctccctcgacatgtggggattacagtttgagatgagatttgggtggcaacacagagccaaaccatatcaaccaaggtactaaggctagcacccaatagttattttttctgatcctcttactcctgccagcctccaccctcaattaggccccagtgtctgttcttcccctctttgtgtctatgagttctcatcatttagctcacactcataagtgagaacatgcagtgtttggttttctgttcctgcgttagtttgctaaggatgatggcctccatttccatccatgttcctgcagaggacatggtctcattctttttatggctgttatagtattccatggtgtgtatgtactacattttctttatccagtctgccttgatggtcattgaggttgactccatgtctttgctattgtgaatactgtggcaatgaacatacacttgcatctgtctttatggtggaatgatttatattcctttgggtatatatccagtaatgagatatttgggttaaatagtagttctgtttagctctttgaggaattaccacactgctttccacaatggttgaactaatttacactcccaccaacagtgtataagcattcccgtttgcccacagccttgccagcatctgttattttttgatgttttaatgatagctattctgactggtgtgagatagtatctcattgtggttttgatgtgcatttctctaataatcagtgatattgagctttttttcacatgcttgttggccatatgtgtgtcttcttttgaaaagtgtctgttgatgtcctttgcccactttttaatggggttgttttttccttgtaaatttgtttaagttccttatgaatactggatattagacttttgtcagatgcatggtttgcaaatattttctccgattctgtaggttgcctgtttactctcttgacagtttcttttgctgtgcagatgatcttatatttaggtcccatttgtcaatttttgcttttgttttgatcacttttggcatcttcatcatgaaatctttgcccattcctatgtccagagtggtattgcctaagttgtcttccaaagttttttatagttttgggttttacatttaagtctttaatccatcttgagttgatttttgtatatggtgtaagaaagaggtccagttttaatcttctgcatatggctatccagttatcacagcaccatttattgactagggagtcctttccccattgcttgtttttgtcagctttgtcaaagatcagatggctgtaggtgtgccgccctatttctaggctcggtattctattttggtaccatactgtttttgttactgtacccctgtaatatagtttgaagttagataacatgatgcccccagctttgttctttttgcttaggatcgccttggctatttgggctcttttttggttccatatgaattttgaaataatttcttccagttctgtgaaaaatgtcattggtagtttgataggaatagcattgaatctgtaaattgctttgggcagtatggccattttaatgatatttattcctcctattcatgagcatgggatgtttttctatgtgtttgtgtcatctctgatttctttgagtagtgttaacgaatcctttttttttttgagatggagtctcactctgtcacccaggctggagtgcagtggtgcaatcttggctcactgcaagctccgcctcccaggctcccaagtagctgggacaactacttggtaggtgcccgccaccacacctggctaattttctgtaattttagtagagacagggtttcactgtgttagccaggatggtctcgatctctgacctcatgatctgcccgcctcagcctcccaaagtgctgggattacaggcgtgagccgccacgcgtggcacaaatccatttttttatcatagggtctatttactttagttggagagttttcctaataattagacaacttaatccatttattcagtacatgagaagagagctctaaaaatgaatggatatgctaatttttacattcatttttctttttttcctccctttccttccactctttagcctatatatgctccaaaagtggaggggaggaccttggacagaaatcctatataactaaaccagacatgcatataaaaatgttattcatagctcttcattttccacattgttcccccaacagaatagaaacttcatttccttttgaaaatagtcatatatgtttgttgtaactggggacttgaaatgattctttctattaaaatcactactgatatttgaatcaagtatcaaggtatcttatgtattttattttgaaattttaaagtataaatgactttagagataaggtagtagattcttttattttaaaaaatgagacaatgagcatcaaagattaacccaaaccttagaacttgctaatagcagaacccaggacttcttactccagtataggtttgtttccatgatttcctctaacacttaataaaggatgagatggaaaaaaggaaggagggtcattggagagtttaaggtaggaaaacgtttgggaacagtaaaaaagcagccttggccaggcgtggtggctcacacctgtaatctcagcattttgggaggccgagatgggtggatcatgaggtcaggagtacgagaccagcctggccaacatggtgaaaccctgtctgtactaaaaataaaaaattagcccagcgtggtggcacacacctataatcccagctactcaggagactgaggcaggagaatcactttaatccaggaggcgcaggttgtggtgagccgagatcacaccattgcactccagcatgggtgacaaagtgagattccatctcaaaaaaaaaaaaaaaaaaaaaaaaaaaggcagtgttaaaaaccctctgatcatctcatgaccacgtgatttaaacatgacactgtgactgggaaattatgagctaccacacgtggtttttacttgaaatagataccttttcaacaactgaattcatttttcctatactggatcaggtaacatttattttttagcagtctttttttacataataatattgattatccactatatccaaggtattgtagcatatgaactgtgctagttaagtaaaataaagcaaaaggaaaaaatggttatgagaaattgagattgcgctatattcttaatactttttttgagtgacagactctgagaaaattgaaatcttcttccccagaaaggtgcacatccacacaaaagccaaccttaagaatccgtgattgccaagttaaaaccccacttaccaatgtacctgtggttttgaatcattttttcattgtcaaagtataactggaaaccaactgaaaaactcattaactgctgtaaaattctgagcaaaatggctagtaagttttaatttttaatttttgcctttgattatagtatttgaggggaagatcatacgtattttcttggaaatgttacagttttctaattggtagacatttagatttgctagggagataagtattctattgcctcaggataatgttagatctgaagaggtcagtctgtcttttaatctgagtatctaattaagcagatggcttaaagtacatcttttgtatcttcagagtttgtgctttttcaccatattcgcaagcacataatcaatttttcttcctcagtaaatggagttccttggcctcaagaggcaacacgacgaaatagccatacctttaactgcaggatgctaattcaccctccagatgagccagggaccgagaaccaagaagcttgccagcgttatgaagtaatgcagtgtttcactgtgtcacagccaaaatcaattcaagaggatggagaaggtaaagccaaacggtctttttaaagtgtttatttcttctgtgactttaaggaaaagagaggaaattaattataaactgcctttttcagatagtatttttggttactataatatgtatcatagtggctattccatttgctatatattcttaatacttaaaaaacaataattactaacatctagaatcattcctttaatatgccccccagattctcagttttaagctggcattcccactaaaatgtcaaataattcaaaccaacttgctgtctagaaataagagatgtaactaactgctgccagttggaaatgtaccagatgcagcagactgttgaacagctctgatttttagaaagtttcaagtttagagtgtagggaacattggagaatagagttggcatttttcaggctatacaaggtaatttataaggagaaaacttaagaacagatggaaacatgctgaagctctaatatgaacatggtgtcaacatggaattagttaaatatgtgacagtggatgagttttccatgtaaacttagactgggctaagtttagaaaatcacaaattgggaactggagtaaggacaagggaaggtagtagacaagaagtcagtcagatgcaagaaagccatgtatgtagcaggtctcaccaggaaacggaggtaacaatcaactggagactttttacaaaatacacatgccaaatcttacttgattaaagttcatttttagctgtgtgatattgtgtttaacatcctcaaaacaaaacttgggaatgggactttgaaaaaattgtatatcctaaaaacatgaagtcatctgtcaagagcaaaatagtgcttcagagttaaaggttgtttttctcatataattatctacactgtggttataagaataatctttttagccattaagtactggtgaatataagaaattgactacaaaactgtattttaaaaaacactgtgccacttatatctaaccaaaactactacttgtagttgttatcatccagtacatgagatgcatctctctcctctggtatatataagagcattcaataggaaggaatggtttatgccaactaactctctacctggagctgtcagtttttggttgccagcaattttatttctaatacactattagataagaatgatttcagtattatgcaatattatgtcaggtgctgtaacacgtttttgtttttgtttttttgagacggagtctcgctctgtggcccaggctggactgcagtggcgtgatctcggctcactgcaagctccacctcccgggttcacgccattctcctgcctcagcctcccgagtagcggggactgcaggcgcccgccaccatgcccggctaatttttttgtgttttttagtagatacagggtttcaccgtgttagccagcatggtctcgatcttgtgatccacccacctcggcctcccaaagtgctgggattacaggcgtgagccaccacgtctggccaacatgtattgtttttatgaaaaccattaatggcgagtgatagatataaaccattttctactctctatccttcaatttccccgtcttgttttgggcagatttccagtcatgtctgatttgtattgcacggcgattacctcggcctccagctattacgggtgtagaatcctttatgaccaagcaagatactacaggtactaattgtaaagttcagaatgttccataggtattaataatgtgactctgcccttaaaactaattatatccagaatgtctttctgttctatgagatttaggctttgctccctagtcttatacagaaaacattttaaatggtgctcttgagattatacaatttagatactatgatcattatcatggtcagggtgctggggaacactttttataactttatatacctatatttgtttgattacaaattatttttcaaatcatggaataaaatgtttaaagaaattgagaagatatagatatgtaaatatgtagatatacatacatttatttaaatagatatgaatatggtagttttactattatgcttaaacgtatctggctatttttttttttaattctttttctttaaatttatttagcacataccgattgagtccctagaagtgcctgtcattaggtgattcctcaagatgtatatggttgaacaaaaatgattcagtgacaaattgtgttatttttgatgatggaagttatgagatggtataagggaggatatatgaaattagttggtcagcaaaggcctgtctgaggagctgatactgagccccaaaggatgaagtggtgcccactacttaaagtatgggtcttggaaggggggcagcaagaaagggtcttgatgcagaacgagtactcctaattgaggaaccagagctgcagaagtctaaagataagcaagacagagaggtaagttagaagtactagaaggagggcaggagagcctcaaactgagtaacagactgcctataaataaggcattcttcttaaaggcctacttcagattttattttcagcaagaacaagttgttactgttctttatagttgatgaagtatttttcttatattatttgattttatctttacactaacatgttgtatgttcatgcttttacgacaaccagagttacatatatatcacttacctctctaattttaaaatagagataaatattaaaggtatattttctagcagactaagattttaaaaataatttcttctgaattttatgctttgtgaaagtttagttttagtgtacattttgacttttaccacctttttataagatcctatttcattatgtattaattttttagtgccaataatctaatattctaatgttgtatactttgtgcttgtgtttttagagataaacttccaactgctcttactaaagaactagtatggataaattagcacagataatagaaaatggtaaagagaatgtctctgagcatggagagatggcatctaaggatagtaattatcaattatcatagccttcttcattctgtttttgagtctaccatgtattatgttcctttccagtctctaccatgaacaacactggaaaaatttaataaacgtactatggatatgtaggtttgtccaaaaacaaaaatttatttaaatttttttaaaatttttttttaattattgaaaattgaaagtattttgcatgaaggaaaaatagagtccattgaaaaagaaaattggtcttttctgtcagtaaccagttaacataaaaagaaaccaaataagggctttgtgagatagcagaatgaaaacatgttgaaaaaggttattgtcaggtcacagaaaaaatgtcagagatgggggaggcctaaaagttatgaggctaatttaggaacaatatgtttcagcttttcctcatattgcatttgtataaattgaattctaaattggattgctttgaggactgtattttcccataagaacagtgttatccctggtagttttgtttctaagaacccagctgttaaaattttagatatacctggtaatatgtataaatatataaaaataaccataatcatgtaaaataaaaaattagcctctgggccataaaataactatatatatatagagagagagggaacctccaatatcacagaatccaacctagatttacaaatgaggggatggtgatttgatcaaaaccatacagccctttgccgagaatggacacctttaggccctaatgtggagccctttcttgtattacattacttttcactaaagcactattaaaagggcatcactatactgtacacagttattgtacaaagataccaaggaaatataaaatatgcttaaaatgtaaaactaacattatataaatcatagaattgacttagctaaaaagaataagtataataaatgttaaacatttaatttcttaagtttttgtagtactttttaactcttcatgggatgatccatatctcttaaaaaaagaaaaaagtattttactaggaaatgttgaacagtggggctttttattgttgtttagttggttggttaaactttcctgtagtaggcagagtattctaaatcaagctgttcatgattcttcactaagatagtcattatattacccatctggtaccattgctgataacttaatcactttctctcctgccagtccccaaactctaaactctcatgctctctggtggggccaaccctgacatgaacacacacatgcatatgcctcccttagtcactgcctgtgaggagcattattgtataggaagattatgtagcagtggaatccctgctataaccaactttttatctctgacataagaaacaagggttgaacaattaaaattcttaaaaatctaaaatcttttatagtttcagttacagtgttcaccaggctttccccaaactgttcttaaatgacaaaatttccttgagtttcagtttattttctttctactatttacatttatgccaagacttaggtgataacctgatcaagtaggactgggtacatcagattcaagacccgaagttaaaaaggtctaatgaatattttatttctaaacaaaatgagatatataaagaggggattagttcaatgaggaggcacaaactggatgatagatttgagttgattgtatgaagaaggggaagatggggaaaatatttaatcaggcattcatagaagaggaaacattagtggtgaactctaataattgggaaataaaaatttagaccacaatgagatagcatttttcacctactaatttgaaaacataaagaagcctgacaacacaagtgatgaaaggatgttagattagcactaactcttacacattgctggtggaagcatagagtggtacaagtttcaggaagacagtttaaaattaatattataaagttgaacattcacataacctacaatctaacaattctgttcctacatatatacactagagaagttctcacatgcatgtaccatgcaacacgtgaaagatgttcatagcagtgctgattgtaatggcaaaaaaccgataacagtctagatgcccattcacaggagaatttaaagatgggggtggtgacaagggaggagtgcacatgtgatggagcaatattggtaacgtcaagttctgaagttgagtggtgggttggcaggtttttatctcattaattcttaatttatatatatatattctatatatatcttgtattattttgtgtgactgtaagattctgtaaaacgtaataaaacaggtcttaatattcacaaactggattaattggccctctgttaactgaggaataacttacctgaattctctcatagccatttggaaatttgtttaaatatgataacaatggcgaatcaccactaaattttataaagcgtatgttccgtgtgcatactgcctagcaaatcttaatgttctcacttactgtttttctgatttaacttttgttgtcttcagtctttgtttagtcttaaatacagtattgcctacagcccaacaaaggttagaaaggaaaaggcttgcttcttttctcatattctcttcacttagtagttagaaattaatttaaaccaaaaaatatacttcatctttgcctctcctttccaatcggtcatcagtatacagagagcagaatccaaagaccaagccagaagagtttgaactgcattagtctcagtagtgtcaggtcattatggtatgactttaatcctagaccagaattgaattttagaatatgacatactaggacataacacattctaagaccaaaacaatttcttatgtcaataacatacttcataactataataaaaattaatagtgctttttgatgcttttgtttattgagtatttggaaagaatatttcttagatgcagttgttagttttgaaatacagatgatttatataaagaggctgttataaatataaactttcattctttgtacaggtaaaatcatctctattgatactagttccctgagagctgctggcagaactggttgggaagatttagtgaggaagtgcatttatgcttttttccaacctcagggcagagaaccatcttatgccagacagctgttccaagaaggtaaaattttctctctcaattattttcattaacccttatctttactgatatttgaatagttcgtatagaacttatggcttgataagtattttctccaaattatagtttttgcaataatcagttttaggaaaggaagaaatgggtaagcaaagtaattcatgagtggatcctgaaatttgggatacacgttctgaagaataggatgttgtgtggtggtcactcattcattcattcattcattcagcaggcatgtatcaagttcccaacatacgtagaacactatataaggtgccagggatacagtgatgactaaaaaagaaggttttgcccttaaagagcttataatacagtaggaaaatatacgacaaccctaaagatcagtttgatgtggggtatgatagaaccataaccaaagaagaaaaaaattaattctgacttgaagaatcaaggatgacttcagaaaagaagtaatattttgtttggctcttgaagatcattctcagcagaacaagcatgtcaaaggccttctagataatacagagatcagtatcatgcctgtttacttcatgactgttgcagaacctgtatctcctgactcaggttgaaatttcaagtcaaaaaatatatcctatgaaattattaattattgcatagcttctgggtcttagtaagtatcatggaagtataagatatgtatattccctgcccttaagaaacttaacagtactacaggaacgataggaaaagttatttgagaattaaggccagaaagtttacagaagttcagaattaaatggctttgatatactttaaaaatattgtcatttaattatggtagcctaacattctttttccaatgaaatttattctctaatctctagatagtttcttttgtaagaatctcattgtatggcttttcctgaaaaacaatttaaaaatatgtttcattattttgtcattcttaattttaacatttttcccataacattagatttcctaagtttacggatgattttccattcattacattttaggtcaactgcttcctagtgatacatggaggaagtagtttgattttttttcttcttccaggaaacatctatataaatatcacaatccaggtatttctggaacagcttcgtacagactagtggttctctaatgggctccttactagacttataccacctcctaagattgtatttcactgggtagagctaagaatctgtattttttaaaagtttcccaggcaatcctgaagggcagccaggtttggaaaccattacaataagtaactaatgccgtccactggatgtgaactttgtgatttcctctggcaagggtgatgcttgacttttgcataggtttgggactcagagcactgtttcgactcattgcctgaagttctcgagtttatggtacttttgatttttgccttaagttgggccttccaaggctttacttaaaagacttaatttatttgcctataatttacgtacattttcactaaggcaaagcagatctggcttgtcttattatccaaatggctaggctccccatagatgtgactaggctacagttgaaggtttctaaaccttcaacggaattccccatacaatgaattgattaaagtattataagtaactagtttgtcattaatatataaactgaaataatttagagtaaaatgtcaagaaatgtaagtataatccaatacctcttccccattagtcatttttaatgttccctcattctactttttttagggaaaaaaaatcctcaatagaaataactgtatttttcttagaatcaagttgtccaaagttcacgtgactgaatcgagtgttttggagattctaaacaacctgacaaacaggttttgtggattgagcacagccttttttgatattttctattcagcagtatctagccagatatgagaaatgtggtcaatgaaacactttcatgagaatcacctgttaaagatagtgacctgctgaattaaaatatcaaatgaaggcctgcccagatatcttaacaaaccttaaagctaatgcttaagttggccgggtgcagtggctcatgcctgtaatcccaacactttgggaggccgaggcaggtggatcacctgaggtcgggagttcaagaccagcctaatcaacttggagaaaccccatctccactaaaaatacaaaattagcgcgcatggtggcgcagtcctgtaatcccagctactcggaaggctgaggcaggagaatcacttgaacccgggaggtggaggttgcggtgagccaaggtcgcaccattgcactccagcctgggcaacaagagcgaaacttcatcgctaataataataataataataataataataataataatagtaataatgcttaagtttgacaatcattggtccatcaagattggagagaggtgttatttgcatttgcagttttcttgctgccttttcacttagggacagtataaaaagagtgaaacagattatgtactatcttcctgattttgtgtagaactttacagtgaatgatatttaggcaggaaaagtttgtcctccatctgttttcttttttcctgtccattaacttactctttgatggcagcaactagtctaaaatcctaacatgcgttaaaatttctagttttagtttagttttttagctgcttttgacagtcagctcatgaactgctgtcaaaaggagtttactattatattttccagaatcaagtttgaaaacacatttcaccttgcatgaattagattaaagccacggttttacattgagattggagggaaatgggtatcaggatcacttgaggaactttttaaactaggagaagatccatgcaagtgtgtatagtttggaaaaagttcccaggttctgttcaattcaaaactattactttaaagaaatatctaggtcatggtgcttcccaaggtccctgataagatagatttatctggggcagttgttaaactagatttctggaccccaccccggactactgaatcagagtctatagtctaagatgtttacttacagagaagtttgtaaactatgaacctaggttccacaaacttaataactataactaggaaatgatgttttatgggtaatcccactttaggtgatttataagatatatttaaggtatttaagtttctgagaagttctacaataaaaataccttttaaattttgttattgagacttttttttcacagaatactttttcctggagcacatctatcagcagttagatagtagtcatgggaaatgtcaggctatacaacctagaaactagttgtatgaaagttctgtttatatatatatataatgatgtaatggatcatcttttcttgtctttgaaatatccatgacatattgttatattaaaaagtaggtggctgggcacagtagctcatgcctgtaatcccagcccttgggaggctgagacaggaggattgcttgagtccagaagttcaagaccagcttgggcaacatggcgaaacctcatctctacaaaaaataaaaatacaaaaattagctaggcgtggcacacaggtatggtcccagctagtcgggaggctgagatgagagaattgcttgagcccaggaagtgaagacttcagttagccttgatcatgctactgcactcaaacctgggtgacagagtgagacactgtctcaaaaaaaaaaaaaaaaagagtagaccaagagagcacagcatatataatatgatctcacttttacatatctttctatttatccaattctagaaaattaacaaaattttaactgtttatctctgcatgatggaattacaaatgacttgacttgttctttgttcatctctctattaactttatattaaaataaagccattttcatcttttaaaaaatatagttaaggctagccatggtggctcacgccagtaatcccagtattttgagaggctgaggtgtgaggatcgcttgagcacaggaatttgagatcagcctcgccaacatggcgaaaccctgtcctattaaaaatacaaaaattagccaggcgtggtggcatgagcctgtaatcccagctactcgggagtctgaggcaggagaatcccttgaacccaggaggcggaggttgcagtgaggcgagatcatgccactgcactccagcttgggtgacagagggagaccctgtctcaaaaaaagaaaaaaaatatatcatgagtcaaagctggaaagggtttatggtattaagtttggaagcattgctataaaacataaagtaccgatatcaatgattaattagaatgttctttgagacttgtgtaatgtgattaagtccacggtccatgtaacaactgaaaatctttttatgtcaaactttgttaaaaatatttaaaatgtgagtttactgtcctcttagtgattttgatataatagagtttactcattggtgattgagaattttagaacatctaggggtaattattttttctgtacctaataacaattttttaattctttatctttttctgcatatatttaggtgactaccacaaagaaaaataaacctctaccggcattgacccatagtaccctgccacacattttttcacctgcctattttgttaatatcagtcaggcatgcttgtttgaggttatctcagcaccaaattgggagggatcaaaaacccaaaaactttgcttctacagctgctgtaaccagggaaaatttaatgtttcttttgctttgtagctctgttgaggcctattctagggataaaaataaataaaaaataaataaataaaagcggctgtcatgttaaaggttctttggaaggattctgaggtgtcaataatagtccttcaatattatctttcctcactaagtgttctaaggagtttagaaatggacacaggaatcagagatcagaatactaggtataaagatgacaaaattaggtcagaaaactaggccaggacctataaacaaaatgggattccaaaactaaaccttgaaacccacttaaagggaaaatttgatgtgtacggcaaatgtttattgaaccaactctgtaaggagctgtggctaccttactcatctcttaattcaaagtattagtgattgttattcagagttgaagctgttgccataaatagtgtctagggattgactatgtgtgtgactcagaacataaatactttggaagctgcgtatttgttgggtttttttccctctgatgtttattgaggaaatactcattcaatacctgatatgtactccatgctaggctccgtgctagatattatcttacaatgttgttggctcagttttagtaatgagttgactgagatgggtgaatgttaatttgcattaagtcttaaacttgtaaatgacagtgagaggtcaagcctgaatctgactcctaggctgttactcttttcattgatttatgctgccttcctttgacctcttcatctgaacaattaagcaccagacttttagttaactggagagtcttactgagttctaattaattgaagttttaccatattaaatattgcctctttctcatttccaagaatggctgaatgaattattaaatgccaaatcttagtccatacattctcatccaaaacaaataatctaatttcaaaacataaagtgtggtaattgtcttgtattaaattaataggcttccctaaattcaggaatttttcctagtttagatacattatatttagtaagtatgccagtgatttagctgaaattgccaggtgtgtaaagaatgtggttggtcaaatataagtcttatcctttcaattaaatttatattctggttttggtacttaagcagatatattatggtatagatttacattaaactatacctttttcagttggtactgtatacacaggacaataaaatagaacatgtcttgtttaagtaacatgtaacttcaaaaattatttattaattggtaattttaagcctctttctcatggcctttaaaatgtaatcaaagcccctttgaaatgtctttgaaaaattggactaacattttatcacaggctaaattataatagtcatttgtggtagtactcaatctttcttaaaatagaattatatggtattattaaaacatcagtgatattttattacataatagtctggcatagcctttacgtatttaataaatacttacatgattagaattttttctgctgttagtaaagctttaagacaagagtaaattatgctacttataaagtgacttgactgccttaacttagtttttgttccttatactaataaccattggctacatcttaatttgcttactaaactttaaaaattcaaacattaaaaatagtacacagattttacacatatttataaataacttgtcaaatgggaccttagtgattcacattcctgagtgaaaagttaaatttgaatattagttaaggaactctgtaaactgatcaaaacttagtaaattttatggtgtgtcagtcatatcttagtagagctgttatttaaaaaaaaaccagcaaaagagaaaacaaacttgttaaagataatactgagagtgagaggggagaaaaatatttcctggtatttttaatggagacaataaatttgaagagctgcccccagtatagagaaagattaaggttgggccaggcgcggtggcttacgcctgtaatcacagcactttgggatgccaaggtgaatggatcatttgaggtcaggagttcaagaccagcctgaccaacatggtgaaaccctgcctctactaaaaatacaaaaattagccatggtggtgggtgcctgtagtcccagctacttggaaggctgaggcaggagaattgcttgaaccccagaggcagaggttgcagtgagccgagatcgtgccactgcactctagcctgggcgacagagtgagactctgtctcaaaagaaaaaaaaaaaaagactaaagttgatgtttcccagatttggggttttctcataattataacttctctgaggaggcacccattcaactatgactcaattaaaacctgtcatcaagtggtatatttcaactggaatcatcttccccctcagatatctgctttgtctgaactattctttattctgagtctaagcaggcaacagttgggagggcctttaaaatgaggttctaagtagaaataaaacctggtgacttaaagccagcgtataagtatcagaattttaactaggtttctcttctgtttgaaacagtgatgactcgtggcactgcctccagcccctcctatagattcatattgaatgatgggacaatgcttagcgcccacaccaagtgtaaactttgctaccctcaaagtccagacatgcaacctttcatcatgggaattcatatcatcgacaggtactacttatttggagagcttcatatgaaataagccagttcacatatctcttattagagaaattttttatactcttgatggctagaaagcagaaattctaaattaggcgtaaaactagtgtgatgagtatatataatcaatatatccatattgggttttatagttttatcatgtaatagctttgttgttcataaagggaggtaggaaagctgaggctgaaaatctgctttttagagggtaaaaccaaaaagatggctaaaaatttacaacattccatatgtgaatcttataagagatttgtgagtttgttaacattgttatttttatttttatttttgaaagtgctctattttcattagggcatacttggtggctcctgagttcaagttgacaatttctcacagaaattacaaatcattaaactatcaacttgatttttgagtgccattgtctctaatttgttcccctaagtatgttttacactgatatatggtaaattcatgaaactattatcctatgaattattagaaatcctacatttacagtggtgaaaatgtagcattaaaaacaaagacatttcccctcacttcatctttttctcatctaatgtatttgcttattggaacatggtaatgccagtcacaaatctgttgtcataattatgaatttgagtaaaggactcactgaaaacctgaattcagtattgtggtttttttctacttttagtttaaattatgcttgtgagtggaattagcacagttctttttttttcatattgtgatttctctttcaaaacatctgctatgtctgcatatcactctttttaatttttacatcagtgacacagtattttccttacccagtcttcctctttggagttgaaatacttaaaagctgtaacaggagtcataaataagtgctttataaacagaggtgtgagaagtttatttttcaaccaaaaaattattataatgttaattgtgtatattaggcttagaaattgtttaaaagaacatatattggattttttccaaaaccaagaaaaatttttacattatattttacataaaattatattttacatataactgagaccattatcaaatgtaagagtcgataagcattatttcttattaagtggtgctaatattttacagtagttttttcttaatttaagaaacttttttcttaatttaagatggtacagaagctctttacttgatagcttgcaatattaatgagatcaatggtcttgttttagaatatgtatcataaaaatattttaatagaaacaaatgaagatgtttgaataataatgtctttttccccctagggagcacagtgggctttctcctcaagatgacactaattctggaatgtcaattccccgagtaaatccctcggtcaatcctagtatctctccagctcatggtgtggctcgttcatccacattgccaccatccaacagcaacatggtatccaccagaataaaccgccagcagagctcagaccttcatagcagcagtcatagtaattctagcaacagccaaggaagtttcggatgctcacccggaagtcagattgtagccaatgttgccttaaaccaaggacaggccagttcacagagcagtaatccctctttaaacctcaataattctcctatggaaggtacaggaatatccctagcacagttcatgtctccaaggagacaggttacttctggattggcaacaaggcccaggatgccaaacaattcctttcctcctaatatttcgacattaagctctcccgttggcatgacaagtagtgcctgtaataataataaccgatcttattcaaacatcccagtaacatctttacagggtatgaatgaaggacccaataactccgttggcttctctgccagttctccagtcctcaggcagatgagctcacagaattcacctagcagattaaatatacaaccagcaaaagctgagtccaaagataacaaagagattgcctcaattttaaatgaaatgattcaatctgacaacagctctagtgatggcaaacctctggattcagggcttctgcataacaatgacagactttcagatggagacagtaaatactctcaaaccagtcacaaactagtgcagcttttgacaacaactgccgaacagcagttacggcatgctgatatagacacaagctgcaaagatgtcctgtcttgcacaggcacttccaactctgcctctgctaactcttcaggaggttcttgtccctcttctcatagctcattgacagaacggcataaaattctacaccggctcttacaggagggtagcccctcagatatcaccactttgtctgtcgagcctgataaaaaggacagtgcatctacttctgtgtcagtgactggacaggtacaaggaaactccagtataaaactagaactggatgcttcaaagaaaaaagaatcaaaagaccatcagctcctacgctatcttttagataaagatgagaaagatttaagatcaactccaaacctgagcctggatgatgtaaaggtgaaagtggaaaagaaagaacagatggatccatgtaatacaaacccaaccccaatgaccaaacccactcctgaggaaataaaactggaggcccagagccaggtgggtaactgcttgcttcacagaatggtcattcttagtaattttttttttcatttattctattccatctgtagaccagatatgaattcatactatgttttatcctatccattgggcatatattaagaggttagtatcaataactgatcacaggatgccctcagaagttttctttagaacttcagaaggctacagttttaatgcagaattataaaaaaggaaatttttctttctctataaaatcagtgttcacatctttagacattttttaaaataccttccctgcccctctctcccagccctacctattgaatctaactctctaggaataaaacctaggaaccaaacctaagtctgggaacccctgatgtaaatgaagtgggagagaaatgtaaggagatggacaaggttacttagtctggcttgttttttatttcctttgaagcatttcctaaggctgttttttccttctcatctgattctgaccaccctcagcaatcagagaatagggacttgaatattctgggtaacagaatattgcccttatgtaacatgacctgaaacagacgtaaataaagacaaacctttccataagttgttatggattagaaacctttatgtttaggatggggtgaaagtggtgtaaaagtaaacaggtatcttcatttattgtataattgcttatggactctgaaggaatatagtttaaaaaaaaatatggcccttcctaggagctttcaccttatttagagacagaatatagacattcattaatcagcagacaatgtatgtacaaagcagtttatccacgagactccattctaaagcatgagtcacacttagtatgcataggtccttcggtttcttgaatcagcttagttttctgctctcatttcacaagaatcactctcttccctcagaaatactgcattctaggcagatggaagtccttgtcattcctagaataagccatgtctcttctaaacatattctgccttgctcttctttctgtgcccactgaacttctactcatccttcacaaaccaattcaaataacatctgcataaagccttccccaagtatccctagttagacatttcctgcttctgtccttttgtggtgcttcatatcatctctgtttactctttgtagtaacactattttgactggttctgtgcatgtgtgttctttgaggataaggctgtctcgtgtttcttggtacaatgaaactaatttttaagcagaaaacagcattaaataataagtatatttaaaaggaaaagatttataagataatgccattgtgttcagttctggtgcatctgttttgtgcacatgtgtatgtatttctgttgagctgcttcttaggagtagaactacaggataataagatatgcatatgtcctttttcagtagataatgccagttttcctagtgtatcagtattttttctagttgctccaagtccttgttaatacatgatattatcaatattttagatttttagctattctgaggtgtgtgttctaatttgcatttccctgataaatattcattggtcatttggatatcttcttttgtaaattgcctagtctagtctcgtgaccattttttaatgtgtttttattttgcttattgacttttaagagttctttatgtatgagtcctttattggacatatatttgcagacatctttttagtgctaaggcttaccttttctttctcttactggcactttttgatgaggtgaagttcttcactttaatatagttcaatttgtcaatcttttcctttatggttaatgctttttgcacatgtgtaacaaaagacatgttcacaaatgtttttaacagctttattcgtatcagccaaaaactggaagcaacccaaaaatccatcacaatagaatggataattatgttgtgacatattcatacagtgggacactattcagcaataaaaatgaatgaactgctgctaaatgtaacagtgcccaaacttcagaaatataattaaatacatatatgtaattctacttatatactctagaaacaaaaatttcagttgaactagataatgaaacccaaaaagtaatcatagtatagcaatattgtgaaataaaggccagttttcttctctacataacctaagacagatgtaggaactccctatttattcttttttattttattttattttatttatttatttatttatttttgagatgggagtctcgctctgtagcccaggctggagtgcagtggcacgatctcggctcactgcaacctccgcctcccaggttcaagtgatcctcctgcctcagccccactagtagctggagttataggcacgtgccacgatgcctggctaatttttgtatttttagtagagacggggttgccatgttggccaggctggtctcgaacttctgacctcaggtgatccacccgcctcagcctcccaaagtgctgggattacaggtgtgagccatggcacccggcctccctatctattctaaaagatatgtttcttattaagtccttaagtgggaagtaaccattgtgatatctttaaagctgataaataatttatgaaaaagttttccaaacttttttaaattataaaatagttgaatcaatataagtttaaagtaagtcattttatgaaattttgaaaaatatgacaggaaaaagtcacccataatgctatcatcataacacagtactactgacacttttttccagtccaatctttttttatacatagatttttgtaccaagatatagtagccaaatatatgtgtattatttatatcctgcagtatatgaatactattatcagaagcatccaaatattttccccatggaatagttagctcatgtaatttccaagtagccccaatcattctaattatttcttctttcttcattatctcaaagtcacactgaattcatagagtttaaagaagcagcatttttttctacgttgtttcaggtgaaagtgtaaaatatatttcctctaactttggtttccattcttagtttacagctgaccttgaccagtttgatcagttactgcccacgctggagaaggcagcacagttgccaggcttatgtgagacagacaggatggatggtgcggtcaccagtgtaaccatcaaatcggagatcctgccagcttcacttcagtccgccactgccagacccacttccaggctaaatagtatgttctggggacaacacctcattttaaacgtttagtgataatgtggattagcattttgtctctcaccagtattacacagatcctttgcttaagagtgaaatatctttttattaatgccactataaataataaaacagttatatttaggcatgtgaacatcattcatcatgtgtattttaaattatgacctctatccttttgtaattaatgttaaggtgagcaattgatgttaaggagaacaattttgtcgtctcacccaaaacaccccataacaggactttcagaaatacagtattgggtcagattgtttccagatatcttccttgaaaactaatcctgtgagttgcagaaataaaagattctgtactaaaatacactgggcaaatgctacatgttccatacatttcatattgatgttttaatgcctattagcagttttgagaagccttgtattaaagaatgtagtttagatttcttttacccaacatttcccaaactttcctgattatggaatttcttttctcaagtaatacatgttataccacagaatgagttttccatgaagttgcttaggagacaactgtgttaaaatatgttattgttctaacccaagttagcattttcctagttgagagacactttgatagtttaatacattaaatttatgaagataaggctgtcagatttttttgcccatcacattttgatgttgaaaaaaccagtggtaagaattccattgtatgaccttgaaactaaaggaaactaatcagcccactttcaaaattagtctggattttcaacgttagttctatcccttttctgatggtatcatatgtgggacttcagttatttcagtccaactggaacttttaactgtcatgacccaattactgatagtttgccaggatttcagacagctgcgaagaataatcttgaatccatctgtgacatttttggaggcagtattttagctgaccagagtattagaggaagagtcagaagcctagattcaaatctcacattctccagtcattaacagtcttacctcaaggaagtacattttttgaaccttattctctttatctgcaatataagaattagattaaatgattttgaaagtttcttctaatagaagcagtgaggctctagactggaatgtcagtcacaattgaggaaacagtaagatgcaaggctgaaaagagataaaatgaaagtctgcatattgattgatttggaggtctttatctccttccccatccaatatgggagactggaagaattttctcaggggacattgaatgggcggaaagatgtctggatgtgagtatataagtacaaaagccattctgctatctcatcatccaacaatgaaggctcccagaagagacaagcctggcactcagccctcccagtccatgtttaagaacactgactgaacagacacagtcaagaatcatcagtacttggaggaaactctgcaacttgaaagggagaaaaagaaataaacagaaaaagtatgcagtggaaatatataatgaatgcataaaccaaaaaagaaaaaaactactagaaattttagaaagataaaaatgtattacccctgaaaatatggaaagggaaaaaaagggacaaagaacagaaaaaactcttggaaattaggtatccaacttttttttttaatgagggaaatgtaagatgatacagctgagaaaagcttccagaaagaacaaaaagatgctcccagaaagacaaatgggaagtagggaagaaaaagttaaggaaattacaaggtccacctcagagggccagtaatgattaagaattacacaaacaggccaggtgcggtggctcacgcctgtaatcgtgcactttgggaggctgaggcaagcggatcacctgaggtcaggagttcaagaccagcttgatcaacatggtgaaaccctgtctctaccaaaaatatacaaaaattagctgggcatggtggcaggcacctgtaatcccagctacttgggaggctgaggcaggagaatcacctgaacccaggaggcagaggttgcagtcagctgagatcgtgccattgcactccagcctgggcgacaagagcaaaactctatctcaaaaataattaattaattaattaattttaaaaattaaatttaatttaaaaaaataaaagaattacacaaacaagggtgggaaacatcaaaaaatataagagaattttctgattccccagattacagtgtttcaacaagtacccaacacaaatggaaaaaaaaagtacttgtaccaaagcttgtcatcatatcattctggaacatgagagataaagaaaagattctaaaacctttcagagagaagttaattccatacagtgaatcaggaattttcaaaggtaatattggaactagaagacatttatgatttgagaaaaaggacttctactttcaactatgacagcaataattggcactggtctagtcctcccactgtaaataacgggaaaaagagcaaatacattaaacaattcttgtaagccaatagataataggcagtgtgagactgtgatctctctgagaaggaagcaagtcaggtgagctctacaatcatctcagcttttttcttggagatgtttaccaaaccaagtacaggtaggaggaacccaaaataagcacggatattttactaaactccgaaaatagtgataggagttcagtgacagtggggcagctagaacttgctgaacaaagtacccgagaagagaaggatatgtagaaaatagcaacaaaaatctgaatcagggttcttttctatccttggctgaatactacactgtgcatgtattcaacgatactccatcaggtggggcaaagaacagtttgtgaaggaagaacaactatcaggaaggagtgagctgaacaactaccagaactcacacaagattggaagataatcaagtcctgaccaatcagagtcggtagaccttcttgaacatctgggacatttagtggaaaatggcctcactttaagagtggatttaccctagacctgctttgacatcttaaaaacaaacctcaaaaggatcaagcttatgtacaagtaaattaactgtctgaaagaacactattcaatagtttttaaagaagacaccaaaattcagacattcagcagcattatattcataatttccaacatataataaaaaaaattaagacacatgatgtagcaagaaactgtgacccatacccaaacaaagtcagttaatagatccagaaatgacagagatgatagaagtaatagaaaaagatttgaaaatagctattctaaatatgttgaagaacttaagggacaacatgaacataatgagggaagagatataaactacaaaaaaaaagagccaaatagagctggtagagctgaaaaatacagtatttaaaatgaaaaatttgttggaggagcctaccagcagattagacactgcaggaaaaaaagagcaataaacatgacatagtattagaaactactcaaattagaggagaaaaagaataccacaaaagtattgaaagacctcagtcacctgtggaacaatacaaagcagtctagtatacacataatatataaataatacataattatggaagaagggggagcaggtgaaatttttgaaaaaacagccaaaatatttacaaatttgtggaaatttgtaaacctacaaatccaagagtttaatgaatcccaagcaaaataaacacaaagaaaactactataagccatgtcataatcaaattgctgaaacaaaaatcttaaaaccaatcaaagaaaaatgacacattatgtcagataaacaagaaaaaactttctatacttagtatcattcaaaatgacacagagatgaaaaaagatagaaaatgatataagatgaacaaagataagaaaacaactaactttctgtatccagtatcattcagaaatgcaggtgaaataaagatgttttcaaacaaaccaccctgagaaaatttgtcaccagcagattacactattgttcaagctaaaataaaatgaatccagatggaaactctaacctacagaaaataataagagagccagataagtaaaggtatgaataaatggaaaattcttttttctcatttgttagtttctttaaatgaaaaataactgtttaaagcaaaaataataacagtgaattatatatgtaatatgtagaagaaaaatgtatgacagtaatagtaccaaaaatggggtagaataaatgagacaatactcttttctacaaaatagtataatatttgaggctagaggctaaagttaaaaatgcatttttttaacagaaaaatattctataagtgtcctgcatgtagaaaatcctaaagaagtgagaggaaaagctacttgaactaaatgaacttagcaaagtcacaatatgtgtactcagtattttaaaaaatcaattgtatttctgtatatcagttacatacaattggataatgatatagaaaaagcaatttacaaaatacataaaatattaagacataaattttagatggaataacatgtgcattactctacactgaaaactactttgctgagagaaattagaggggggccaaataaatggagagggataccattttcatggattgtaagacacaattttgtcaagatatcagttattccaaaatcaacccatgtaaatttaatgtaatcccaataacaatcccagcaggcggccgggcgcagtggctcacgcctgtaatcccagcactttgggaggccgaggcaggcggatcacaaggtcaggagatcgagaccatcctggttaacatggtgaaaccccgtctctactaaaaaaatacaaaaaattagccgggcgtggtggcaggtgcctgtagtcctagctactcgggaggctgaggcaggagaatggtgtgaacccaggaggcggagattgcagtgagccgagattgcgccactgcactccagcctgggtgacagagtgagactccgtctcaaaaaaaaaaaaaaaaaaaaatctgagcaggcattttagtaaaatttgacaagctttttctaaagtgtatatgagaatgcaaaggtcctgaaataacaaaaaccacttaaaaaaaaaaaaaagaaaacttgggagtatttatactgcttgattttaatacttctataaagcaccagtcatcaagatggtgtggttttggaataaaaatagacatatagatcaatgcaaaataatggagagtccagaaacagacccacatttatatggcgaattgacattcaacaaagacaccaaggtaattaaacaaagaatagtcatttcaatacatggtgatataacaactgaacatctatgtagaaaaaaatgaacctcaacctctctcctcatcccatacacaaaaaaatgaacttattttgagttgatcataggcttaaatataaaagttaaaactataaagcttttcaacaaaaaaaagtcattgagatagacacatttttgataggacacaaaaagtgctaatcatgaaagaaaaagattgatacattagacttcgttaaatgttaaatcttctgctctttaaagaccacctcttgaaagaaaatgaatcaataatcaataacctttcaaaacagaaatcactaggctaaacccagatgggttcacttgtaattctaccaaacatttaaggaagaaattatattctctctaatctcttccaaaaaatagaagcaaagaaaatatttcctaactcatattgtaaaacacatatctgatataaaggagtgatacccaaaataaacaaagaactcttaaaatgaaacaatgagaaaacaagcaactcaatttaaaaatgggcaaaagatctgaacagacacctcaccaaagaagatatacagatggtaaataagcatatgaaatgatgcccaactcatatgtcattagaaaattgcaaattaaaacaacaatatgctggcgaggatgtagagcaacaggaactctcgttgctggtgagaatacaaaatggtacagccactttggaagacattttggcagtttcttacaaaactaaacatactcttaccatatgatccagcaatcacactccttgatatttacccaaatgagttgaaaacttatgttcacacaaaaacctgcacatgaatgtttatggcagctttatccataattgccaaaacttggaagcgatcaagccatgaaaagacattgctgagaagaagccaatctgaaaaggctacacatcctgtataattccagccgtattctggaaaaggcaaagctgtggagacagtcaaaagatcaggagttgccaggggtttgttgtcagtggttgccaaaggcaaggatgaataaggagaacacaggggattttatgtgataagtatcatacctaaaaatcccctgtgttcatatcatgtataaataaatgtacatagacatatacacatatatatatataaatcatgtgtatgcaatgacatgtatctatcctgtcattctgtattggtcaaaatatcaaaatccacagaatgtacaacacaaagagtgaactctaatgtaaactgtggactttagttaatactaatgtgtcaatattggcttatcagttctaacaaatgtaccacactaatgcaatagtaggaaaaactgtccaatctaaacactgggcaaaggattttaaaagatatttcacaaaggaagatatgaaaatggcaaatcagcatgtgaaaagatggttaatatctttttttttttttttttgagtctctctgttgcctaggctggagtgcaatggcatgattgccgctcgctacaacctctgcctctcaagttcaagcaattctcgtgcctcagccttccaagtagctgggattacaggtgtgcaccactatgcctggataattttttttgtattttcagtagagatggggtttctccattttggccaggctggtctagaacttctggcctcaagtgatccacccgccttggcttcccaaagtgccaggattacaggtgtgacccactgctcccggccaagatacttaacatctttaatcatcaaggaaatgcaaattaaaactacagtgcaataccactgcatacccattagaatgcccaaaattttaaaaactgaccataccaagtgatggcaagtgatggcaagggtgtggaacaatttgaacttttacattgctaatggcatgtaaagtggtatagcaaatttggaacattgttcagcaatttctcataaagttaatcatacatttaccatgtaacccaacagttcaacttttaggtatttaaccaagagaaatgaaagtccacgtccataaagatacttgactacaaatatccatacagttttattcaaaatagccccaaactgggtgggcgcggtggctcacacctgtaatcccaacattttgggaggctgaggcaggcagatcacttgaggtcaggagttcaagaccagtctggccaacatggtgaaactccatctctactaaaaaaaaatacaaaactaggctaacatggtgaaaccccatctctactaaaactacaaaaaaaaaaaaaacaaatcagccgggcggctactcaggaggctgaggcaggagaatggcctgaacccgggaggcagagctggcagtgagccgagatcgcgccactgcaccccagcctgggcgacagaatgagactctgtctcaaaaaaaaaaaaaagccaggtgtggtggcgggcgcctgtaatcacagcttctagggaggctgaggcacgaaaatcacttgaacctgggaggtggaggttgcagttagccgagatcgcaccattgcattccagcctgtactacaaagtgagactctgtcccaaaaaaaaaaaaaaaaaaaaaaaaaaaccccaaaccggaacaaactaaatgtctgtcaacaagtaagtggtgtattcataaaatgaaacactgctcagcaatgaaaaggaaggaactataatactattacataggatgaattactcttggaaacatgctaagtgaaaaaagccatatatattcagattttttttaagctctcaaacaggcaaaactaatctgtagtaatagaagtctgatcattgtttgcctgagttaggaagattgatagccaaggaacatgaaggaaattttagaggtgatagaaatattctgttttcttgatttgagtggaaagtcctgggtttatacctttctcaaaatttgttgaactgtacaaaatttgttgaacttaaaatgggtgcattttattgtatgtaaattatacatcaatgaagtttagtttagaaatatctgagagtagaatgatttccagccaataactatcacatttcttgtagttgtaaagatagaataaagcattttcagatataaaagacctcagattttatctgcttgatatattcaccttttctagcaaaggtcctggaagatgtccttaaacaggggaaaaccaaaagagacaaaaccaaaagagacggaggaagcaaaggatctgaaaggaagcccaggaatgacagctgatccacaagattagggaacaaccagtgcatattgaaccgggggcctggcgaatcctctagaaaggaggcctccagagaagaaatgaattgatctccttgagtttatagaaaatattattgatagatttatgtcagaatgttgaaacatctgataaattctagaaccgctgacaaatgaaaacataagaaaattattaactccagaaaaaagaaagtatggcacaagagaggaggttcgaacaaagtgcacaatttgacttagcagtgagcaatatttgcataatcataatcaaaatattagcttttgattttataaaaaactatgatctctgttagggaattgggaaccaggatggtagtaagagaggtacatgtggaagaactaagacctcatctataatgaggggaagtcagtaaatctaaaatggagacatcaagaaatagcaatatatgcatatttagaaataaataggcaatgccaaagaaaacagttttcagagttgcagatggttgcctctattgagaaggaggtaactaagtgactggaaggggtgaggcaagaaactgctttatttattatgggcctcttggttctgacttataaaattatgtgtgtgtgttaacttgataaaaactagagttaatagaaatagtatctgctagctttgcaagttgtgaaagtggggtgttttctgtcatagtctgtattgaggcaaacagcttttttctcccttgaggcttcccctccggagtacagctccataagtgaaagtatgtaaataggccagaatctgtttcacctcgtgctaatatgttcgcaaaggccaagagcatagaggggaagataccaaggtagatatgggggaggtcagtagatgcagacaaccagtctacaatgtgtagatatagacaggaaagaaaaaagaattcagagaccataaggctaaggaaacaagttgggtgtgaaaaaggaaaaaagaattaaggattgcagaaggaaaaagaaagaaaaaagatgggaacaaaaatatgatagcgtataaagagaagaagaaaagaatcacttctaattctctgccccactcttacctctaaattgtcccatcactactgtctactagaaccagagtctattattgattggcccacatcttaagtttgtgcccgcccaggaaaatcaagcacctttccttactttagtcttcaatcttagctgaactgtgtcacgtacaaatatcttgcataggatagtttaattatcatcctccttcaccacctgagatacacagttagaagtaatggctctatcccccatgacacttatctttttctcttatacttttcttttccttgccattttgcactgtattctgagagaatctctgagctcaactttccagatcaaaactaaatcttcagctatgtccatcctgcccttcagtccatctattgagatcatttcatcatagctataattttaagatttctaaacattctttttcttaggagtctattactttttatggatgcaatagactttttaatctgtatgatgatatttattgtaatttggggttcactcattttctatactaactcttttttcttcaacattactttcttcattaaagttgctttctttctcctgttgacttttcttgaatgtttggtaaattttgactgtctctccatatatattgaaaaagatctagaattttaaaatactggtagctagtgtatttctttagctaaagtgagaagcccttttcccctggcagtgaatgtagattctgattatagaagccctacttctcagttgttgtgaggaataggccttggaggtggggaaaccccttgtggcagccctagcaccccctttgggagattccctgggcagaactcccattttgagtcatatgctcacaattgtaatcccatggacaggtgccagagtcagctgcactcagagcaatggcctggcagcagctgttcagccatccataattatccagcaattgcccatggcctgttcctttatttgctcaaatgaccactgagcctggagttgttctggtgttctgggaaaattcctctctttggaaaatctctttctcctgttgcaagtgttttagtttagttgaagtttcacaatcagtttgtttccatttgtgttttgtctttcagaaattcttcgttgttttagtcttctgccatgaaaatttcttctgcctttccttcggctgtagatttgtgttccccttttttctttcttgagttatttcagtggtgtttttgaagagaaaataaaatataagtgatatatctgccacattgaaccacaagtctccttgggttcgtttacaaatgagaaaacaaaggtccagagaaaagggagacacataaacacacacagacaaaaacttccccaaagtagtatttgtagaataaaccaggatttaaatctcaatccacctggtttcaaaacatgttgtgtgtatgcacacacacacacccaagcagtgtggccaagtgatttaagtaattttgttagaaatgttctaccagagcacatccaggtaaatactgctttttcaatggagatagcttttatgagggtactgttgatcagaatgtgtacagcatgcctgtttgtcagtaccttcaaaacctttgctgtgtccttttgactatcttcaaatccctattgtttgagggtagatttcacttttgaaaatttccagtcatgtggaaccaaatacgttgatctaaaaagaataatgctgttttttttaaatcaaaaactaaaaagtgtacctatgaggaaacttattttcttgaaggacctgtggactggttgagatagttcctgaagaattccaaaaatatttaagcattgacatcactggaataagtgaatgaccgtgtgaggcagttgtttttgtgttctgtgaacataaacattctgggataatttttttttaatcttattaattcacagtaaatcaaaaatattgtataactataaaaatcactattttcgtatgcaacattttcagtacctaaaaagatccatttttcagcttgggcaacatggtgaaaaatgggcaacatgggcaaaaaatacaaaaattagccaggcatggtggtatgcacctgtagtcccagctacttggggagctgagacaggaggatcacttgaacccaaggaggtggaggttgcagtgagccgagatcatgccactacactccagcctgggcgacagtgagaccctgtctccaaaaaaaaaaaaaaaaaaaaatcctttgaagttacatttcatggtttttgtatatttgtttatttatttttagtgattaagatattcacggttcaacattcaaaaaagtttttaaaatatatagtgaaaaatatctttcctggcagtatcgttttttctgtaccttcaaaaattacgtacatagacttccctttttaaaatacaaatagtgtcatactatacacattagctgttctgtatcttagtcactttttcacttaatgttctatggatgtcattctgtatcagtgcataaagagcatctttattctttttttatagctgtacaacttcttacagttgtaccagaatttacttaaccagtagcctgataggcatcttttgctatcacaaagctgtaatgaataatcttatgtagagataatttaccacatgtgacggtatatctgagatacaagttctgaatagaattgctgggtcaaaagatagatattgccaaatagtcctttccagcagttgtttcagcttacaccctaactgataatgtttccatttctgcatatccttgccaatacattgaattatgtactttctcatttttgcccatctgatggttttattcttttaggtatctcaatgtcattttaatctatatttcttttattgtgaattagatcatattttaatgattttataatattcatttatgttcatattctctacctattgtcttactgggtttttatcctattgatttatagaattttttatatgttagaaaaatgagttctttgtctacatcatgttttgaaaaaaataaaacactgtaactgctgtgcagttactgccaaatgtaacacaaaactaaaccagaaacttccttaacaacagctgaagaaaattaactgtgaatatcaaaatcagtagatactaaatcaactgttagaagagtagaatgtgcaaaagccaccctcatggttaagaaaatgctttctacttggtgtacagaaatttttttctatatcctaatcttggaagtgacagaaatttttaaattatttcttaatataaggggggtttttttgtttgttttttgttttgttttgttttgttttgttttgtttgctgggttcagtgtcccttttagctatattttaaatggaggaagtatgatgttgagccctttgcaaagatgataacgaatgttaatagcttgatcgggggatccctagggcttgttttctgcccctacttcagctgcctgtttccagcagaaatgactgtattgtcctgtattacatgtatacttactcatgtttgtgtcacagaaatgaccaaaaatatttcatttattctctggacaaagagagagagcctgtgtatttcctagaagaaatacgtgaagcataccttcacattttttacagaaggcagtttctaaagaaagtcgcaaaaggttgaaatgactttcagaataaaaaccaacttcttttaagcatgcagtctatccaaacaaaacttttttttgacttaaaattttattagtatggggatttttttgtttgtttttgtttgcttagtcaccaaactcagcatatgaatcttattttgaaaatattttatccaacttattttcttaacatttttttcaagactagtaaaattagatactgtgtcctattactgagtcaaataaactatcttgcaaaacttagtattgctagtagacagtggacagccatgtaaattttcttagacttttaaattaattaattttggttataataattaagattagatttcttgaaataagattgaggaattaacatgtaggcagagccaatgggacagttttagataatctttgaccaactttctgatttaaataatgacagaaagtaagtgattatttccctttttttttgttgttttattttgttgtgtttttcagaatcctacagaatttgatttctatatcatttgtcatgatagagatgaggttaatcgaaagctgtaattatatacatttaaaagtaaatgtgtttatgtaacttttatttctcagttatactaaatattgaatatattcacttagaagtgagccttgcatgtattatgtagttaataatgttcagtaactagcattaagtacattttgggaagcatccttaaatctacttattcttcattcattcgaatgagaaattctacctcaataagctttcccttaaaactccaaggctgttttagtttttaaaaaaagattctatttgggctactataacaaaataccactgactaggtggcttaaacaacagaaatttattttctcacaattctggaagcctaaagtagttttggtttcttctgaggcttctttccttggcttggagatggccctcttctctctgggtcaggttatccctctgtctgtattttttttctcctgaactcctcttcttggaaagacactagtcatattggattagggcccactgtaaagacccattttgtcttagttacctttttaaaggccctgtctccaaatatagtcacattctgagataccaggggttaggacttcagcatattaatttggaggggggtacaattcagcccataacaatgatcaattaatatatattcattttagaaatttcaaataaccatcatagaaagaaaagcagcctttaatctcactacctaaagtggacctaaagtgtgcgtgtgtgtgtgtgtgtgtgtgtgtgtgtgtgtgtgtgagatcccagaatttttttatattaatatatatgaaatagtttataaaaacagagtcatcctgaaaataatgttttggaatatgttttcttttttcatttaacagcacattgtcaatatctatgccataattcattaatcagtccctaagtttctggaatttaggttatttataaatttttttctagtataaatagtacagagatgatcataaagctttccaaaaaagcgttacagaaaaacgttctaaaatgcatatactattttcttcaattacaaaacataattcaacttcttttttcatttgggccatcattataagtctcagttcttatactgttattgtacagctatattctaagattagcaactgtagagctgtgttcatttgctgcatggcctcagattctagtttctgttcctgcctctgatagaatgtattttatcttttgctcaccactcttatttcgtggtgatgacactgtgttacttatagcatattctgatatgtgactgaaaagcagataaccaaaattgttaaatttatctttaagataaataatttctgacaaagtcctgagtgattctggataacagtaacctatgtacaaactttaatatcagattttccttgattcagaaatcttttttcactttctcatttacttttttattatgtggtcacactagatagtttaaattgctgaataagtgacctttgtatcattgaagtaatattttaaaggagaaatctcactctccaatatattatttttgaaaataccatcattttatcctccactgagataatgacttcttaccttttcttcttaaatcaggattacctgagctggaattggaagcaattgataaccaatttggacaaccaggaacaggcgatcagattccatggacaaataatacagtgacagctataaatcagagtaaatcagaagagtaagtaatacattttgtattttataaggtatcagataccaacttctaaacagagaactattttttccaaactacatttcagtctacagtggtattttgtgagatattaatagatgtaaatacttactaaaaaaaaaaaaaaaaagtgggcccggtgcagtggctctggcctgtaatcccagcactttgggaggcggaggcaggtggatcacctgaggtcaggagtttgagatcagcctggccaacatggtgaaaccccatctctactaaaaatacaaaaaatttgccaggcgtggtggtgcgcagctgtaatcccagctactcaggaggctgaggcaggagaattgcttgaacccaggaggtggaggttgcagtgagccaagattgcgccattgcactccagcctgggcaacaagagtgaaactctgtctcaaaaaaaaaaaaaaaaaaaaaaaagggtggcggggacaagggaaagacactgaattaaacagatttattgactgcatgaccacaaggctagtatacgttgtaatcaccaagagattgatataatatgtagctattgttttatatttcatgtattactttaattgattaccataatgtatctgggacctatggatgaattggcctcagtacaataattatattgctcttgaacttttagttatattattattttgtccagcatttctcttcgtttggtgcaagaagttataagaaaggaaagtatactttttacatctactcagtgtcacatcttgattagaattgaatttcttactccccgcaggcagccatattccataacgcaggctgcgtctcatacctgccaaccacaggaagactagatagtattgattgtggtttagcgccttaactatgaactgtattcccatttaccttctcaaaggaagaatgcttataattgtattattagtgttattaggattagtattattttgtatatatttctgttttatgtatcagttggtatctatttggattagactgtatatttcctacatgtaatcagtgaataatttgttgcttaatacctagcatatttcatttttccagtttgatttcttttgtaaatggtaatcatgtcatgttaacaatcaaaatgatttgatcatctttaaaagttaatataatatgtactgttttgattgtggttcagttattaacaattaatggcattcataaaaggtaaataaatagaataagtagaataaatctgaatataggctaaatgattttttctcagtttttggctgattttgtttttacttttattaaaagttatttcccctttcttaactgtttggttaattttccaggctatttctggaacataaagaatatgggaacaaagttcaatgactgacaaaagaatgaaaactatattcaagctacataccaaatactcatttaatttctacacattaaacatagaacattccatggcattagaattgccaagcatctcaacagtgaattttctaagaccaaatttgcatctatatatgtatataaagattgaataaattatttgctatgtcagtctgaaactttcttgttttttaatcctgcagccagtgtattagctcacaattagatgagcttctctgtccacccacaacagtagaagggagaaatgatgagaaggctcttcttgaacagctggtatccttccttagtggcaaagatgaaactgagctagctgaactagacagagctctgggaattgacaaacttgttcaggtatttattaaagtcaacattatttaactgatggagccctaagaagctagaaaattattttaagcaagattttaaagtattgtacccactatgctttagctgttttataatttacctcttgtgaaacttatcaaaatatatgagttttttttttaagaaaaagtattacagtaattagaattagaaataagtcttagcttttcactatggaacagaatcttacaagctccagccagaatagaatccagatttatagcatcacttctcattttagagcttaatttatccttcattcacgcttgtcttctgccagtatattccatggtattgcaacttccaggttagccttttttacacgatagggtgataaaatcactttagtgcatcttgaccagcatttttaaatggagtagaatagtgtagaatacaaagtatgagaatgcatagcccataaaaagaagtcatgttttgtgaaactcctttcagctgcatacaaacacacacacacacaagcacacgcgcacgcgcgcaattaggtcacaatttatatttcttacagtgggtaatagtgaaaacatttggaaaccataacgctacagctttctgttacatgagctgtggatttttttttcaaataaaagcatgaattttatatctgagatagaaaaatgcctgcttgatccctcctttaagaatctacttcctatagtaagctattaaatgtaaagtttattgattcttaggctttgcaatgaagttttttcccaaaccttttagttttatttcattgatttggagcctttattttaactatattgccatctctttactgagattttaaatatctcagctaatccgttactccatttcaaaagcagcttttataaatgatttctttaggtagtaaacttctggagagcatgaattcagaatgaatatatgatggtgctttctagaaatacggaagcatgttacttattggcagaaatttatttgtaaaatattctggcttcttttctaacaggggggtggattagatgtattatcagagagatttccaccacaacaagcaacgccacctttgatcatggaagaaagacccaacctttattcccagccttactcttctccttctcctactgccaatctccctagccctttccaaggcatggtcaggcaaaaaccttcactggggacgatgcctgttcaagtaacacctccccgaggtgctttttcacctggcatgggcatgcagcccaggcaaactctaaacagacctccggctgcacctaaccagcttcgacttcaactacagcagcgattacagggacaacagcaggtaagtgctcttgtttagcagttgatactttttttttttttgagacgaagtctcacctgtcaccaggctagtgtggctagtgtgcagtagtgctatctcagcccactgcaaccgccgcctcccaggttcaagcaattctcctgcctcagactcccgagtagctgggattacaggtgtgtgccaccactcccaggtaatttttatatttttagtaaagacagggtttcaccatattggccaggatggtctcgatctgttgaccttgtgatttgcccacctcggcctcccaaagtgctgggattacaggcgtgagccaccgcaccctgccagcagttgatactttttaaaggtatataccaaatctctctgcaaggcagcccagttgctacaataaaagtgtcaagtccactcccagaactttcatgaaagacttgaagagccatccttcctctcctaggaaagggataagggaccttttcattcaattaaagacctttcattcaattaaatcaattcattcaattaggctcctaataaagcacttagagacctataacttaaagaacaatttaatttttattttttgagatacaaactatttaaggggaacatcatacaattattaaattaagagaaacagcttaatttacaaagtagagcatcaagagatactgtttatgattattggaaaagaaaataaagtttatttatattgattgaggttggagagattgatgcccagtgatgttactatattaggagaatgaaggagaataggggcctgggagttgtgagtgagttaaatcttctctctcatgacaggaaatgagtaggcgtagtggcataaatatttaagattgtataagcaacagatatggagataatcattaaggaccacaagagcaaacagttaaaaatgtctgctgtgggccgggcgtggtggctcacgcctctaatcccagcactttgggagaccaaggcgggtggatcacttgaggttaggagttcgagaccagcgtggccaacatgatgaaaccccatttctactaaaagtacaaaaaaaaaaaaaaaaaaaaaacgggcatggtggcacgtgcctataatcccagctactctggaggttgaggcaggagaatcacttgaacccgggaggtggaggttgcagcaagccgagattgtgccattacactccagcctgggtgacagagcaagactctgtctcaaaaaaaaaaaaaaaaaagccagctgtgggaagggggacctgagctgtagattgttgctgcttgttatgaatcttgtagtttctaaaaccatatttgtatattgccttgaatttttataaaagtatttaaagaggttccctggagacttactaattcaggaaggaagagaaagaaggagataaattatactggaaaggcagtatgatgtaatggttttaagagttctagtttcaagtcccagttccaaacttaagtgggttgccttaatcaaatgatttaccttttaaaacctctaattcctcatctataaaaagagtctaataaagaactcctttccctcactggtggttgtatggaataaatgagacaaaacatgtaaagcttgtagcataatgcctggcatattgtagcagttgataaatattagctattactataaagttgcattcaataaacataatatgtaatataaaatgtgcttccattctgtttaaaaaaaggaagatgacgaaagagaagagaaaaggagaactaagaaagggaaattttttaaatgatagaataacaataaaaggaataattttttaaatgctagggtagaataaaggattcaaagaagaattaaaggaagagagaggaaaagagaaagagaaggaatcataaatgttctgagatattaattgaagataaactacttcttgtagctttccattcatctttagatagagggcaccagaataagaaatgcttaacagtttccccgtgtttaatttttcacagaacatatttaaggggactacactaggtactataaggaatacaaggaataaaagaaacaggcaactgcttggctttttgactacaagacctgaaaaccattttgactacatacctgaaaagttaagtgacgctgcaagcagtatgtgattaagggctaaaccaaaaaagtaaaggaaagtgtaggtgtgctagtttctcattttacaatgtaaagttctgtaaatactgcctaatattaaagggtcaatgagcaaggccagaccaagggtctaggtcaggttcatgaatgaatggaatgatgattcatgcttgattcagaaaaaaaaagttgttttggcttccatttgctcctaaaacagctgataagcagagaagccctgcaaaggtatgagaataagatgcaaataagtgaaagttgctgctctttgcttcccttaaatctcatggatgcctatccagagatggcatggtaacctaacagagtaaagtatccaccaagttgaagaaacacagaatttggggctcaccatgttataagccccatgtatgtctatacgcaaaaacaacttctactgcaaactaagacagtaactctgctacctaacgagccacatatcggggcctgttccttctcttttaagccataagttcttactgtttcagcactaggtcgctcagcttcacttgcactgcaagtactaggagttttacatgtgtccacttaagggctttctgtgagcaggtctggccaaggttctcagtcagtgtcttggttaagatgctttcagccacaaggaaagaaaaaaagatcaactcagcatagtaaaacaataaagaaaatattttgacccaattgacaatccaaaatgaaagcagaccaaggtgtggttacttcagagattcagggatgttatcaaggacccaggttctttctctttttgctctgcaatccttggcatgccatgattacaaataccgtaggcaaacaaaactataactagcagaagaaaagggactgtttctttcctatgtacctctttccaaaagccaggaaactttttccagaaggtcttcccaccccatcccccgccaaaaaaagaaaaaaaggaacaaaaaaaaaaagtaaaaagggggaaaaaatacttcacatgtctgactagtcagaactgagtcacatgtacacccttaaccaatggttcgcaaagactgactgagaatactcctggattacccctggagttgtgtgatttgggatggtcagctgaacaaaatctgttctgtcttcaagaaagaaggggagagtaaatggctgcgggttggcaataacagtgcctgattaaatcaagaaattgaggtttaaatatattgtttaaagttatatagttaaattcacagttgggataaaatagtgaactgaggtagtattaatatatctcccctttctcctgccttaaatcctattaaataacaggttgtattttttgtgtctgtgactaagttcatgtcagtgtagacaaaaaaaagaacaccattagcgcactaaaaattaagtcattttgaaatacaaaaaaagcaaacatgagaaagaaacaaaattatatgcaaataatacaactatttatatagaaaatccaaaagaatctggccgggcacagtggctcacgcctgtaatcctagcactttgggaggccgaggcgggtgggttgcctgagctccggagttcaagaccaccctgcgcaacatggtgaaacctcatctctactaaaaatacaaaagttagctgggcatggtggtgcatgcctgtaatcccagttactggggaggctgaggcaggagaattgcttgaaactgggaggtggaggttgccatgagccaagattgtgccactgcactccaccctgagtgacagaacaagactccatctcaaaaacaaaacaaaacaaaacaaaaaacagaaaatccaaaagaatctatagggaacttagaacaaatagagtagttcagcaaggattttagataaaagaacaagaaacaaaaattaatggcaattctttttactagaaaattaattaaaaatacattcaggccaggcacggtggctcacgcctgtaaccccagcactttgggaggccgaggtgggcggatcacctgaggtcaagagttcgagaccagcctggccaacatggtgaagccccgtctctactaaaaatacaaaaattagctgggtgtggtggcgtgttcccagctactcaggaggctgagacaggagaatcgcttgaatccaggaggtggaggttgcagtgagccaagattgtgccattgcactccagccttggtgacaagagcgaaactccatctcaaaaaaaaaaaaaaagaagaaaaaagaaattcacactgttcaaaacttagaagatgtggaagtcataattgaaaggcaaaaagaacatccaaaaaaaaatactcatgaaagaaattatgtctcctaattggttgtcgcttgtaaaaagatgacagttgttccaaattcaatcagtaaattcagtggaattccaataaaatctcaacatggaatttgacaaatagatgctaaatttgttttagaagcatcaatacaatcttgaagtattaataaaatgagggtatacttgctctaccgatatcaagatttaaaacaaagctttaaaaattaaaccaggctggatgtgatggcttacacctataacccccccattttgagaggcgtaggcaggaagattgcttgaggttaggagtttgagactagcctgggcaacatagcaagactctgtctctaccaaaaataaaaaaaaccaaaaaacaaaaagccaggtgtggtgatgtgcacctgtagtcccaactacttaggagcctaagttgggaggatctcttgagccagagttcaaggctgcagtgagctatgattgtgctactcactccagcctgggtggcagagcaagaccttgtctctaaaaaaaaaaattaaaacagtgtggaactagcatgaggataaatagttctaccataatagagttctacataatagacggttctgcataatagctctacataatagaaagcccagaaacacacccagacatattgagagacttaataagagacagaggtgacaatggggaaagaatggcgtgcatcataaatgctggtacatttggctgttcatgaggaggaaaaaattaaatttgatcctcatcttatacaagacacaaaaataaactctaagtgttttagtgacctaaatgtgaatatgaaaatatctctgtagcctctttaaaatgacataaaggaaaaagtaaatgtttacattaaaatttacgacctagaagacaaaagacaccataagcaaggttaaaaggcaagacaaagactcaaagaagatgtttccaaccccatatgactggcaaaggactagtgtccagaatacacccagtttgtaatctgctattcataatatatttacctcattggattgatacccacccatctgttcgcttattggtcatatcctctccttccctcttcccaaatacaggagactgtaagcatctcatagcaagaatttagcaccatgcctagtgatttgagaaaagaaaacgggtgtactcagatatacattatagtttccttctttttggtgaattttaaggtcagtttaaaaacagatgttgaaaaaatatatatatataaatagatatcatttattggccatgagtatatctcactggctggtatatactttttactccttgtgtaaaggagtaaaaagattgtaacattttaaattcaattacacagtaatgaataaatccccagttgggaggagagagatgaaaaacatcctaggaaactagtgtatctgtattggttgagatttttaaaaagagcaacaagaaggaaggagctgatgattaaaaagcaatacgaagttacaagcctttaggtgtaatacccgcttactcctcaaataagcaaagacccaagaaatatatccgtaatatcagtaaaggacttctaaaattctattttgggaaaaagaacaacagcaaaaatgggtagacctgctgcttttagaaaatggtatcataggctgggcacagtggctcatgcctgtaatcccagcactttgggaggccaaggcaggtggatcacctgaggtcgggagtttgagaccagcctgaccaacatggagaaaccctgtctctactaaaaatataaaattagccaggcatggtggcacatgcctgtaatcccagccacttgggaggctgagacaagagaatcgcttgaacccaggaggtggaggttgcagtgagctgagatgtcactgttgcactccagcctgggcagcaagagtgaaactccgtctcaaaaaaaaaaaaaaaagaaaaagaaaaagaaaatggtatcattagctgacaaaagatacgatttttccactccagttttgttttcttccccagcaaggatcatgatcttcataactatcaagaggagaataatataaagagaaagtgacagtgagacacataaacaaatatggtatacttagcaatcttaaaacaagtcaagtccagatacgtatgtgttagggtactgaacaaatgtacgtatctgacattataagaaccactattgatcatcttttatatattatagagaatagaagtgatcagaaaacagaattaggattaaaggacagaaaaaaagagagaaacattttaccttcaggtttctggcaatgaaaaatgcccaataggacaataagtttctttaaagaatacttttgtctttgcaagaatttgtgcagtagctagctcagggtttctcaaccttggcattttaacatttggggctgggtaattcttgttatgggggagatgttgtgtgcattaaggatgtttagcagcattcctggcctctgcccacgagacgtcagcagtacctcctctcttagttgtgtcagcgaaaatgtcttcagatattgccagatgtcccttgtttggcagaatcacccctagttgagaacctctaggctagataatcatcttttaggtttcctataggaggacttcttggtaaagcactgggaagaaaatccattccggcagacaaagtgacagccagcctgaactgtgtgtgtttattttatacttaggaatgggtttgccctcttccgctggccacaagccccacatttccttttcttctacaacaagccttttaacctgtgtttgtgtctaaggactaacaactaatctcctcccactccccacctctctgaaagttaagatttccaaggagctgaggaatgtagcgatccttttgggaaggctatgttggaagaagtggaacttgacctacttgttgaaaaacaaagcattttaataattggagagaagaggcaggtcaaaataagacaggtgtacacagcactagtcaggttgcacacacagatagtcaaggggaggaaaaaatgaacaagggttaattcaagggcagaaatagaccaggtttcctataacagaaagtacttgtagatttatgctatttagaataattccttctacttctaaaaaagagcctattactacttgtcaggcatctttcctccatccctacccatttcatttgtacattatctcacaattcaaagaatatataaagctatatgtttggaatgtatttttacctggcctcattgcctcctctcctgtttttttacttgctgttccctctgcctcaagttaactctgccctcctccttgccaccttgcattctcatccttcaagatgaatgcaagctgagctcactcatgcttcttggtccctgtcttcatccctagactgaatgagttgctccctctgtgctgccgtagatgtgtccgtctatgcagacaaagcacctgtgcattttactgttgtgcgttggcttctgccactcaatagggaacggaactcctagaaggacaggaatttgctcacctttgtaacctccaaactttatacagtatcttgaatgtactgagtttttaagtaaatctttataaaattaacttggtttatctaaatttatgttcctggtctttcaagtttaagaagtatatcagttttggtatttaagagtctttttgacttttaaaactataaagttggtatctttctttttgaagtgactcagaacttcaaaaagttttaacttattccacaatgccttagatttgtcattttaacatttatattataatgagcttttccccaaaattggtttgttttctgatctaatgggagtgagaaaatgactgaagttagaattaagagttgagctatttgatgacaagagatttaatcactgttcatagctctttggattcttataaaactttcgtaggctttctagtttatgtataatatattgaaatatatttatgatatataagtatatataatttgtgttttacaaagtatataaacataaaatagtattaatattattgttactgttatcttccggaatagtttattcatatgaaattattgaagaagaaatgttttaagctatacattgttttcaagaaaatctcatttccaagaatacttcttttgttaccagatactgttaaggcatgcctggcatgcctatgacctggaaccctaatcctggtctagactgatcttccaaaccagtattcacagaaaattgttctgagagatagatattaatggttagatgttagaaaaaaaggttcatgataaataaattgcatagtatatcccttcttggcgatccacaatgtgcttttggccaattaaaggcttataaaatttctgcagtaaataaatctgttttaccttgtgtaacccatcatttccagtacttaatacagcacagcatgctgttttcccagcacatctattaatatcctgcagaacaatgttctttagcattgttctttagcataccaatttgggaaatgctggtctaaagtaattactttttctagttaaataaataatccattttttcagaccatttgtttcttacataatactgtctagctaatgaaatcatactggattttccccaaatatgtatccaccagacatagtacctccaagtgagaataccatccagcttgctcaactttcccttcatcttccagacctttgtaaaatgtgcccttactgtatacctgcttttacatttataatattttaagacctagggctggtacttcttcttccccattgcagcacttatctaaaataactattaacatgtttttttgttgttttgtttgtttgtttgtttttgagacagtctcgctctgtcacccaggctggagtgcagtgtgtttgtatcctacttttaaatactttgccatagtgttttggaggcaataagtgttttataaacattgggaactactagccttttggaaaataaacataggaaataatctaaccaaacctgcaacactaaaactttttagtaatcaatagaaagtttgtgttactttataaggcccgtgttatgcttgtgtgtagaaatatatcttattgtttccatttttctctagttgatacaccaaaatcggcaagctatcttaaaccagtttgcagcaactgctcctgttggcatcaatatgagatcaggcatgcaacagcaaattacacctcaggtaatgtgagaaaaccagacgtcattagtacttctttaacccacatagtgtttcttaaagtgttgacttgagtgtctttgaaatggtctgtgagctgatcttttaatgatgtttgtagtgtagttttctttgagaatgaattaataatctacttttgatacctcttactgatatttgatctaaagcaaatggtgctttgttttgttttattgttattattgtcattgttattggataccagatgactaagtagaaaaaactcttatttctgtagcgaatagcaccagtaacaggaagcctctgatacgaaactgtgtgaacggtacccgaaacctgatcaaaacccagtcacattgctaagctgtcttaactatcttgtgtactatgttcaatttgaacatcagcattttctagcttgtatttattttttaaatccctttttttttttaataaacccagagccattagaactttaaacataaaaagaactaggtggacttctaaatgttacctagtactcactctctactttaccccatacatacctaaaaattttttgtttcaactacttacttttatttcataacaaagttgatgtaaaaatcttggagataaggaattttagagaggatttaaacaatactcttttcctctccacaatatggaactagatggattaggagcaaataaagccagcacctgtattattaaagagataaatacagccatgcatgacttaaagacagggatatgttctgaaaaatgtgttattaggcaacttcataattgtgcaaaggtcatagagtgtatttacacaaacctacatggtatagcctacttagcatcctggctatgtgtatagcctattgctcctaggctataaacctgtactgcatgttactctactgaatactgtagacaattgttatggtatttgtatatcaaaacatacctaaacgtggaagaggtacagtaaaatactgtagtattataatcttatgggaccaccgaatttggtccattgtgtgcaactgaaatgtcttattactaaaatgtcttattgctgaaatgtctttatgcatcacatgactgtattgactgaagttgttggtaagcagcagatattgacatcttcatggatccagatttcagtttctctgtcttacaaattataaatcttagtgctagctaattcaggagtaattaggttgtaaggaaacaagaccccacttttggattcacataaagataattcctatcagaaagtcttatttcatagtttcttctagattagactatatgtagttggcaagagctgtatgctttaaccagattctcaatctgaattgacattttctgaagaaggctttattgatatgccatgttacattgaaaaaatgattttaagctaatttgaccacttctttcctcatccataatattataactgaaaccacttacactaatgcctggaataatctgaaactccaataataatacaaaatagctgtttccatttatttctttttactattttatttctacttattttctttttaagtgataatttcttaggcattggatcctagatttcagaatcttccttttttaatggtatttgtaggttttttctaattgtaaaggtagtacatgttcatcgtaataatttggtaaatatagaaaagtataatgaaaattaaaatcacctataatcacatgttattcatttaaataaactgggataatgttctcagtgagaaaagtggaaaaactaagtttctctttaccagaaacacagtaaattttttggaattgaaaaagtcttctaatgatctaatgaaggataggacagaagtcatcaagcacattttctttcacttccttatggtcttcatgtttctcttaacaatgttcatggccaatattataatactaatcaatacatactttctttgaatttttcagttctgtgtgacttttcattgagaatttgcgttctcatttataatggtcagatattgtttagcatttcttgactacttttaatctgtaaaatatacttaattcattttttctcctgtgattgttacttaagaggtttttgttccttttctgttttagtttcccttgtacagtgataattgctatgtactttattgccccaagcaagtaggccttaatccaatgaactttccaggatagatagtgattataataattttagtaagtgagttttttcctgcttttcagccacccctgaatgctcaaatgttggcacaacgtcagcgggaactgtacagtcaacagcaccgacagaggcagctaatacagcagcaaagagccatgcttatgaggcagcaaagctttgggaacaacctccctccctcatctggactaccagttcaaatggggaacccccgtcttcctcagggtgctccacagcaattcccctatccaccaaactatggtacaaatccaggaaccccacctgcttctaccagcccgttttcacaactagcagcaaatcctgaagcatccttggccaaccgcaacagcatggtgagcagaggcatgacaggaaacataggaggacagtttggcactggaatcaatcctcagatgcagcagaatgtcttccagtatccaggagcaggtaggaaggtcacaactttatgttgttctaagtaatccatacaggcttaggtctctctccatctttatgtctgtgcttggacattaaaatagtgtgtggaagaggaaagacactgacgtgggagtctggagacccaggattcagactcagcttttgacactaaatggttgactggtttgaggcttatctcccttttttagctgagatgattgaattagaggatctgtaaggaccttttgagcattttgtatgcaaagtacgttcccccttttttttttcttttttgttagatgcagtctcgctctgttgtccaggctgggagtgcaatggtgcaatctcagctcactgcatcctccacctcctgggcttaagcgattctcctgcctcagcctcccgagtagctaggattacaggcatgtgccaccgtgcccagctaatttttgtttttttttttttgtagagacagggtttcaccatgttgctcacactggtcttgaactcctgacctcaggtgagccaccatacccggcccattctcttattttttaatttttctcattgatctctatgagaattcaatgaaagtcttccccacacaatggattttagtacattaattcaaaattcgcatgtagttttttcattgtgtgggagattttgtttttgccagtttgcataagaataatttatctccacagagtatctcagactactcattggtgtcatcactctcagctgctgctgttgcagcttcctctccaatgtcagtcaactttctggcttccaaaagcttttttcttttttagtctttctttggcactgtcttccattctctttgtcctgggtgataatatcttttcttatttcttttctgtcactttcaggttctgataggtagtggcagtgatgaacatctgattagtctactctgtttaatcaaacttttatgcaaaattaattgtcaattcctgaaaaataattgaaataaatcccttgattatataaatgaaagaaaagaggtaaattttaaggctgcttaaaaatgaatttcaatgagaaagctgctgtttgacttgaataaaatgtcaaagttatacagagatttttgacatggcagtatgcttatcagttttgacagccaaatcaatttagagtttccattctgatggtagcaaatactaaaatcctttgactatcaaattaagtatctaaagacttgtgccagagagcaccagaactctaaagagattttaatcaaaattatgccacatcagtttctttgtcctcaagacaatgaagtcatctttggctggtttatatcagtgacactatctgtgtgggcgagaaaaggattataaatccatattttaattatatggttgcctgaacaagagtatggccttcaaaagagttttatttccatgtgtcttacaatttctgtatgcagagaatttgacaaagctttttcactttagcctgtggaagtacttcctccaacattagaagacttgtgtagtcatctgcatccccattcctcctccaaaatgacaacctgactaaaacagcaaatgggtttttagcagcattcataatattaattgcagagccctaaatcaaaagatttatctcatgcattaggggaaaaagctaactagaagtaagccaaacattaataaattcctcatgaaattattctaaggattttttctattaaaaaatagaaatagtatttctgtccattttcaggcatgtacttttaagtttcctctggaaagtcaagaaaggagaactttatattctgctttcattccttgacaaagccacctggaaaggcggtccttcagtgccccggttctcatgaaattgacaagtttctttcacagttctgggtctagccttttgatctgagttgtgtcagcatagaacaaagtgagctgaaataatggagtgggtggagcttcctctttccccgtaccataatgggaaagatgtgttgccacctatcatgagtatctggtgcctgggtttttcttccagaccaacttctgattgacaaaaatattttcacaaaataagaatttgctttttataaagtcagcattcatactacaaacaaaacccaaatgctgagtgcattgaagagaacagtggtttcatccagttgcaaactgaaatgaaatggcagggctgtcagttcttccatggactgcttcaaaataatactggaaaaatgtttaacttttctggacagagtaagaatgtttaaagatgcaatgtttttaatttctgtcaccactcttaattataaacttgctccaaattgatcagcagtctggtagaggaccaggttttgtgttggcacaaaatgaagttctggaaaagttccagccttttcaaaacaaaaacagtttattgtggcttaaggaaatccagataaaaaggctctttggcctttgttggttttatgcttctattcctaagaaatcggccatacaaaagtaccaaaatatatgtgttccaacatgtttccaggtttgacaaattaaggtccataatccagcccagttgttttggtaaataaagttttaatggaacacagccatacttactgctttatgtattatctatggctggtttcatatagaagagttgagtagttaaagaaactttatggcctacaaaactgaaaacatgtattatctggccctttgcagaagaagcttgctgatttctgtgttaagtgatgacagtaaaaccaacggataactgcattagctttgctttatatcctttgccttagcctctttccacttaatgtaggcccaaagtaaatgaaggaacatgaaagtcatagtaatggcagagtaagttttctggtatttctgaaaacaagaaacttttctagactaccatgctatgataatgagtgtaaaagaacagaatcagactttagaaattgttttcttttttcttttttttttttttttttctttgagacagagtctcgctctgtcgcccaggctggagtgcagtggcgtgatctcggctcactgcaacctccacctcccgggttcacgccattctcctgcctcagcctcccgagtagctgggactacaggcgcccactaccacgcccggctaatttttttgtatttttagtagagatggagtttcaccatgttagccaggatggtctcaatctcctgacctcgtgatccacccacctcggcctcccaaagtgctgggattacaggcgtgagccaccgtgcctggccagaaattgttttctattaaggcagtattcaaagtaaatatgagaaattggtttctttagtgtatctgcccacttcatgggttccttcaagcccatttagagacttcttttctgtgaactacaataaaatcctcttccacctattcctcctcagtgatctcttctccttttggggtttcagggacctttacatgctagtgactttattctctatctctaaacagtatctctcagctcatatgtacagctgcctactggaaacatatacttgcattttccaccaacaccccaaacttaacttgtacaaacctagactcatcaactccatgttcccttttatagttctgtgttccagctacagtaaactctgagttccgagaaacagcacagaccttgttctcttttacttccaggggctttgaacattgtctatactctatctaaagtattcttcctttacttctcattcctattcttccctcctctcagatatatctcctctgcagagtcttcctggacactcccaatcataaagtagtcaacaccctgtcttaaaaccacttgttaacctagctgcctttctttttaaatagcaagttccttacgtgagcagagtgtgacctttttaaccattgtttctccagtgcttagcacagtggtctcacagtgaatagatgcttaatgaatctttgaagaaataaatgaatgaaagtatgaattctaattctagttgccactgtcacatgtctgcaatgctagttatggttggtctagcagggaaacttaacatagtctagcccagctgggcacggtggctcacgcctgtaatgccagcactttgggaggcctaggcaggtggattacctgaggtcaggagtttgagaccagcctggccgacatggcgaaactccatctctactaaaaatacaaaaatcagctgggtgtggtggtgggcgcctgtagtccagctactcgggaggctgaggcaggagaattgcttgaacccaggaggcggaggttgcagcgagccaagatcacgctactgcactctagtctgggcaatagagcaagcctctgtctaaaaaaacaaaaacaaacatagtctaggcaaagatagaactgtaaaatttttcatctagaagaactagattatctgattgatgcaagttatccaaggtccagtgtgtagcagaactgggaccagaactctaagtattcctctaattcattacccacaggctagttctttctgctaaaactgggtcatttcacagacgatttttagagaaatgaaaccactctctatgatactataatggtgggtacatatcattatacatttgtccaaatccatagattgtacaataccaagagtgaaccgtaatgtaacctatagactctggggtagttgataatgaggacagttatacatgtgagtgaatggaggaggggtatgtagcttcatttacataattttaccaaaaataaaccctatctagtgaaagaaaaaactgtaaagtctaaagttaggaaatctcagtaccatccacttagttttgctttgaacctaaagcttctctaaaaaattgtcttttttaaaataataaatttaaaagaccaacactaaaaacaacagcaacaacaacaacaacaacaaaacaaaccacaaaaaagtcatcttctaagggaaactgttcattccaatatgaacagttagaatgtgagatgaagccagaaagaaatatcagaaagcttgctcttgtacttggagtctcttatttattgtttactgttgaccccacaaagtaatatccagaatatgataagcatcttttcccgctcacatatttttatttttatttttctctttttttttttttttttttttaatcttttgagatagggtcttgctctgttgcccaggagtggcgtgatcatggctcactgcagtgtccaactcctggtctcaagtgatcctcccacctcagcctcctgagtagctagaactacaggcatgtaccactgtgcccggctaactattctattttttatagaaacgggtctcactacattgtccaggctggtctcaaactcctggccttaagccatcctcccaccttagcctcccaaagcactggggttacaggcatgagccaccacaccaaggctatatttcttctaaaagaaattaatttcatcataaatgaggttaaaaacacattaatacaagagtttttcttttaaggatcacaaccaaaatagtttaaaatggagagttaatgcaaagacattagaagtgaagatggtggcaaaacaaaaacaaaaaacccaccctctagagtcataaatgaaaaaaaaaatggatgctgggcacagtggttcatgcctgtaatcccagcactttgggaggccaaggcaagtggatcacctgaggtcggaagttcgagaccagcctgaccaacatggagaaaccctgtctctactaaaaatacaaaagtagctgggcgtggtggcgcatgcctgtaatcccagctactcaggaggctgaggcaagagaattgcttgaacccaggaggcggaggttgtggtgagctgagatcacaccattgcactccagcctgggcaacaagaacaaaactccgcctcaaaaaaaagaaaaaagaaaaaaaaatggagacccatatattctaaatcaaaattacttaccttacatatagaggaagcgacaaggagaaaatatgtagcttcatttatataatctttaccaaaaataaataaaccctatctagtgaaagaaaaaactgtgaagtctaaagttaggtcaacttccacagaaaatttaaaacggttttaaaattctagcctataaggccgggcgtggtggctcacgcctgtaatcccagcactttgggaggccgaggcaggcggatcacaaggtcaggagatcaagaccagcctcaccaatatgatgaaatcccatttctactaaaaatacaaaaattagttgggtgtggtggtatgagcctataatgccagctactcgggaggctgagacaggagaattgcttgaacccagatgcttgaagcagaggttgcagtgagcagagatcacgccattgtactccagcctgggcaacaagagtgaaactcggtctcaaaaaaaaaaaaaaaaaaatgtaacctataataaaaaaaacgagtaaattaactacatctctggcaaatataatgattttctctttttatttaaccaaataaaccaagtaaaaagagaaaaaaatcattatattaaaaataaccaaaaaaattacattaatagtgacagaacacagtagatattacacaggcatatatgcatgtgttcacaaagtgacatcaaggacatagaaacatgtttgtgatgtaatgttgagggaaacaagcaggtcacagaatgttacaggattttataaagatgtaaaggaattttactaaattatgggcaatcatactatggcatccttttttctgcacctttataactttctcttccttaaaagtatttaactgtgagatgtattttgtcaggaaaaaaagaaagaaagaacacagtgctagcattaaacattaaacattttttaaaaaacatttttacacttttaaattctaatggatatctactttgggccagtagagtaagagggaccagagttactttcccatctgaaacaaataaacaaaaaacagacaaagtacattcaacagtagttcttgagattgtccagactgtgctgcggggagggagaatccaacaggagccaggccatttccctgagctgaggaggtggagctggcagtctgggaaagccaagacacctagaggtagcagggcacaataccagagaggatagcactacacagagaattgtaggatatgcagagggtcccattcaagtcttcagctgagagctgatgcgcgcacgcgggcatgcgtgtttgtgtgtacaaatcaaggccagagaaaaccacctgaaaagataagagggaaccatcttcaaagttcatacagggccagttcctcttcctaccagccagagtagaaaacctcataattcagggggtatcaagtagaacactcagagatggtttgcctcggtagtggggcaaaataagccctaaactctgctcttgtctcattaggcacaagacctaaaagaattaacctgtttccatgtagcctaaccacagcccagacaaaggtcaaaaatatttaaaagaagagaaaaaaaatccaacacctaataaggtaaaattcacaaggtctggaatctgatttttaaaactaccaggtatgcaaagaagtaggaaaatactacctgtaatgaggagaaaaatcagccaatcaaaaattcagaaattacacaggtgatagaattagtagacagagacattaaagcaattataaattataaattctgtttgttcaagaagcaagaggaagcttgaatatgttaagtagagcctagagccatggaagatataaataaaacccaagtcaaacttctggagatgaaaactacagtgtctgagatttaaaaaacaaaacaaaacaaaaaaaaccctagatgagataaacagcagattagaaattacagaagaaaaaaatagtgaacttaaagatataacaatggaaactatccaaaatgaaatcagagaaaaaagactgaaaaaaacctggtaatttactcaaaattgatcttataattcaatgcagaatttcagcatgctttttggagaaattaacaaacttatcctaaaatgtatatgaaaatgcaaaggacctagagtagccaaaataatttttaaaaggaagaacaaagttggatatctacctaatttcaaaaattaccataaagtcgcaacaatcaagacaatgtggtgctggtacaacatagagatcactggaacagaataaaaagttcagaagtaaacccttacttttatggtcagttgagttttgacaggtcagatggctgctaataagcatcatcctaaataaaaaggaatagcctactgataagtgctccaaagtggctgaacctcaaaaacattatgctaagtgaatgcaagccagacacagaagaccatgtatggctacatttacatgaaatttccccccaaaaagcaaatcttttagagacagaaagtagatcagaggttacctgggactagggatgggagcaaggattgactacaaacaggtacaaggaagggaatttggggaatgattaggtgtctaaactggatcgtggtaatggcggcacaactctataagggaatttggggaatgattagatgtccaaactggattgtggtaatggcggcacaactctataaatttactaaaaatcattgcattatgcagttacagtgtgtcaatttcatgttgtatagattaagtctgaataaagcttaaaagggggaaggagggggggaagagtggctaacaaaactttctcattattttttattttcatacatggctttttctttttcttttttttttttgacagagccttgctctgtcacccagggtggtgtgcagtggtgcgatctcgtctcactgcaacctctgcctcccaggttcaagccattttcgtgcctcagccttccaagtagctgagataacaggcgtttttgtatttttagtagagatggggtttctcatgttggccaggctagtctcgaactcctgacctcaggtgatccacccacctcggcctcccaaagtgctgggattacaggcgtgagccacagcacccggccacacgtggctttttcttaactattatttaatttacagccgggcgcggtggctcacacctgtaatcccagcattttgggaggccaaggcgggtggatcacctgaggtcaggagttcgagaccaccctggccaacatggtgaaaccccgtctcctctaaaaatacaaaaattagccaggcccagtggcaggcgcctgtaatcccagctacctgagaggctgaggcaggagaattgcttgaacccagaaggtggaggttgcagtgagccaagatcgcaccactgcactccagcctgggtgacagagcaagactccatctcgggggaaaaaaaaaaaaagtttaatttactacacaagtaattcatcatgtatgttcatacatatttttacacttaaaaattcacataagcaaaaaagaacagaaatagatcatatacaatcctgctgcacaaataacgtcttagtgaatggaaagcattattccgagcttacatttatttcattggtttatgctgagatttcttgccctagtttaagatactaaattttttccatgctctgttgaatgcgatatttgtaaatatattgcctgacacaagacaaggcaaataagaaagttatttgtaaatatattgtgacagatccttttgggttttttcatttatggggttaataaatttatagtgtatcaacataaattaatttgtgtcaatttacaggaatggttccccaaggtgaggccaactttgctccatctctaagccctgggagctccatggtgccgatgccaatccctcctcctcagagttctcttctccagcaaactccacctgcctccgggtatcagtcaccagacatgaaggcctggcagcaaggagcgataggaaacaacaagtaagggggcagtttttatatatgagcatccttgatactgtgataaatccttgatactgataaatgctacagtggttgaacctcaggaacattatgtaaagtgaaagaaggccggacacaaaaggccacatatggctacatttatatgacgtttccccgttcccccgtttatgtgtggagacagaaagcagcacataagaacagccatgctttcatgggctgattgtattcacaggctaagtagaagattattggctacttccatttgcataatggaaagaactaaattttatattatcagcaaagaaaaatgatttttaaatcttataagtatcaagtcacttctaaggcaaatttgtgtgctgacagtacagaaaagtgatctaggtccccaacctttccatcctaacctgagcacacctgcagaatatgatgagctcacatcagtaacagagcttccctgggacagacatagaaatgggtacttttttaaaagtttttctttataagaacactttaaaatcttataaatctaaaaccaagaatggcaaatgtcagaattcaatagagctgagtagtgggcacacaagtttcacttttctcgatgtatttaaagactttataacaataacaaaagtttttaaggcttaccccttttagaatctctagatttttagtgaccttgactcacccatcttgcttagaattatctcactaaagcctttttttttttttctccaaatcctggctgctgaacttttcacacatcactttgagttttataaggattttaatttggttgtgtcttagttataatgacagggaagctgtctgatctgacaacataataagtaaggcagttaaagttgaaaacacaagactatattcttctaaagttcattgaaaggtgagagaaaatcttcatgttagagaactgtgtaggtctcagtgaggaccatgtataaattaggtagaaatggaaccatatctgtaatacaagaggaatttagtctcctaatgtattctaatcccaacttcctaaactcactctggattttgtggcccatcattataatcactaccttacaggtactctgactcccttgcctatctctccctctgttgcacttatgcctggcaaaattctccctaatgaaatccaactaaactcttactttatacctccacctaagtattgaaatatggcttggggaaaaaaaaaaacagtcatgctgacatgtctcaataacctatttctctgctcccctttacagttaaattccttaaaagattatactctatccacttcccctactcctactccttgttgaactaatcaggctttcattcccatcattccacagaaagtgtccctgtcaagatagttaaatgtccttttcagtgccaaaagcaatgctcatcagtagcatttgacatatttgagcatttattctttcttgaagctcttcatttggtttctagaacaactctctgtcttgagaaaagtgactctcctcctatcacttagtctccttgaggatctttctcatctccatgacctccatttgagggccccagaggtgattctaggacctcttcgccatacccactccctcctttggttgcatcacccatcttactattgtcaatgcctactgctatgcttgactcccaaatttaaacctccagtgcagatggctttcctgaacaccatactctatattcagctgcctaaccaatatctccacttataagtctaataggcatctcaaacttaacatgatgaaaactaaagtgatattttcaccagacctgctcctctgggttactttttcccatttcagtaaatgacaattccattttccacttgtccagaagaaaagtctttctctttctcacatcccacatccaacacatcagcaaatcatgtcagcttcttagcacctctctcttcttacctattccacatgtgcaccttaatgcaagccacaatcatcttttccctgggccattccagtagcttcctctcctgcttccacccttgctgcaccatcatttaatctccacatgggtagccagagccatgcttttaacacatgaggcagagtatgtccgtcctttacgcacaactcatccagtagctccccatcttactcaaaatacagaatagggcccgtaaaaccccacatcatcttgttcctggatacctctctgatcccatctgttattctcaccgctcactctgccacaatggcttccttttatccttctgctcctcagatgtgcgaagtacactgcaaactcaggatgtttgcattttttaatctctctgctggaatgttcttccctcagtggccacatggcttgtctctcacagttcaagtctttccttaaatgtcactttattagacacagacattaaatgtgaccttattacacttccctgaccaccatttctgaaataatagcattttctacccctggcgcctcctttccattctttacttttttcatagtgattaacacttgacatactgtgtgatagtctatttatttgtgatttttcttctccatctagaatatgagcatcataagagcaaggactttattttgtattacttctgtttctccatactctggaacagggaggcccttcatatacatctatcaaacaaatgagtacaaatactccctaagtcaacatcttggattcagattcaaatatgggtataggttttcgttgtattttagtagtttttgcaaactttgactttccaaatcatttgggaaagaaaacagttaccaccaactctttaaacactcacacttgctcatttggttcatgtgcaaaagcttattagtcatcataagccttgtgtattagcgtatatcacctggagacagtgaccactcactgtctctgtcacacaacacaagataccatgaggaacactgaaaaacaacccctgctgccaaataacgaagagtctagttggtgagggggcaggtcagagagaattaaaacatgaaacagtcagagaaccattaagtagaatgatgtaatagagttcagaggtagtgtaacatgattctttttcattatctctctggtggcaagagaaagaaatggttaaacaaacctgtgggtcctggaactgggtagtgcttctgtgtaaggctggttgatgggagaatcccattgcttattagcattttaaaggataagaagtcctgttgtttaaccttttgtttctcagacttatttgaccagggactcccctgcttgttaatacctgtaatatctgtggaacccactctgggccagagtattcatccttctctttttcccatcatttagtgactaccaaatacctagtgctaccctgagaaaactgtgatagctgctacaaagcaggcaggaaagcagagtgaggaagagggcctgtgaatgttggactttaggtgtcagtggacccagacgtctttctaggacctaggacagtgattgcagctgcagaagagcttggtctccttcccttaatgggagatgctaaaatggaactattggcaggagcagtttgaaagaacttaaactaatatacagtcccaaatattaatttgaaaggaaattaagctctaaatttttttcaataagtatgacatcattgcagtccttgaagtttccacatgcattaacttacatagccttgctcctccgcagtggtgacttatgtatcaattgacaaatgagtactgtcttaggcagaaatgttctcattagaaaataggcatagaggctgggtgcaatggctgatgcctgtaatcccagcactttgggaggccgaggcaggttgatcatctgaggtcaggaggttgagaccagcctgaccaacatggcaaaaccccatctctactaaaaaaaaaaaaaaaaaaaaaaagaatacaaaattagctgggcgtgatggcacacgcctgtaatcctagctactcgggaggctgaggcaggagaatcacttgaacccaggaggcagaggttacggtgagctgagtttgcgccattgcactccagcctgggcaacaagagtaaaactcccatctccaaaaacaaaagaaaatagacatagattagtaggcttttttctcacctttagttgtaggatcactgccccataagcatacacactgtgcagacattaatggtccacaggtgtattactgactatttcctaggcatataattttctgtgggcatttttgttttataattacttgggggaaaattctgtacttttcttcagacatgataaataggctgtttattggcctgtcaattcagtatgattaccttagtctactggaaactgtaaatgtcagtatatccttcttaacactaagagctagcgaggaatagataaactattgatggggaaaattatttctaaaatcaaattctatagaattaatattaaaataggtggaattttaccagcagtttattgttaacaattaatatatagtcataaaatatttgatgtttatagaacttaggaaagacagaattaatatcattatcctttagatgtgcatatctgtatcaatgaaaattttcagggttcaaatacaaagtgtcaagttgaattcccatggagtttattgcttactattctacttcctaatagagactgattttacatttgagatctttggtgtaacaacagtccagaacttggccatgaagaaggaagtcagtaaaacaggctctctgaaaaacataactgcttatgtattttgcttcctagaaaagacatgaagctatgttgaggcctgataagaccttggaagtctttaaaaggattaaatttgccacctaaaaacatttggttgtatacatctggcttcctcttaatttgtagcatattgaaagcgaccagaagataaaaccttgagaagtgacaacaagctataggatattgaataaagggtctcaaattttagtatgcatgaatagttaaagatggacctttctatacccacccctggaaaatgtgattcaccagggcttgagtaaaacctgggagtctcaattgccagtgagtcccagggtattctcttgtagatggtctctgcactacacttcaaaaaatgtatgccacttcactggcacagatacagtaaaccatttaatagaaaacaatctgaactgcaccatttgacagcaccgaataataatccatgccataattcatttattcatcaggtatttactgagtgcctgctatatgtcacatattaatagagatgagaaataagtggaacaagataccatcactcccctgaagtattaagtctaagaggctctacaagcaaacacaatataaggatgctgtctttgaatcattcattcgtgtgttaattcattcagtgaacatttattgaagatatatatatatatgtatatatatgccagacactttgctcaaataggacattctctgtttagataggtaaatgtcagttacctagaagatttacttacatggaaaacttcctttcttaattatttagatgattgtagcctagcatctctgatattgtgccagataattgttatttaaaatgagctcttttcagttatttaatcccttatgtagacttcagaatgtatctgaattatattaatttttatatattttaagaagttacagtcatacatgcaatttaaggatgtaacatattttatttggaaacagaatctagtcatatatccccttgttcatgatcagtggatgtaatctggattgtttttgagtttacagtgtgttcagtcaagctgtccagaaccagcccacgcctgcacagccaggagtatacaacaacatgagcatcaccgtttccatggcaggtggaaatacgaatgttcagaacatgaacccaatgatggcccagatgcagatgagctctttgcagatgccaggaatgaacactgtgtgccctgagcaggtaagtggcacactcgccacacacatgccacaccacatcacagttaattctgaggaaaatcaggtatgttgacagttactcatcagaaatagccacacttctttattctttcccactaacttttaataattactggctcttaagatatacaatgaaaaattttgacagacttttttttttttttttttttttgagatggagtctcactttgtcacccaagctggagtacagtggtgcaattacagctcactgcagccttgactgcccaggctcaagggatcctcccacctcagactcctaagtagctgggactgcaagcacatgtcaccctgcccagctaatttttttactatttgcagaaacaaggtctcactatgttgcccaggctgggcttgaactcctgggctcaagcaatcctcctatcccagcctcccaaagtgctgggattacaggtgtgagccactactcctggccttgacagactttataaataagatttcagtttcatgagattttagtgttttagatttataaaacagtacatggctgggtgtggtggcttatgcctataatccgagcactttgggaggccaaggcagatggatcacaaggtcaggagttcgagaccagcctggccaacatggtgaaaccctgtctctactaaaaaaaaaacaaacaaaaattagctgtgcgtggtggcatgcacctgtaatcccagctccttgggaggctgaggcatgagaattgcttgaacccaggagttggaggttgcagtgagctggtaattgcgccactgcactccagcctgggcaacagagcaagactccatctcaaaaaaacaaacaaacaaaaaaacagtacatgtaatatattgtcttggaatattccattatattttgaaacattttcttcatctctaccttttaattcaataagcatttattcagtacttactgtgtacaaagatagccttgtgggacatgcatatgtacaagttgggaaagacacaacatgaacaaaggatcattttaatcataggacaaaactggtatgtaagagataggccatatgtgtttctgtcagatgaggagtgtatgcacagttgactactgagggcttaaaagaaaaaaggcctggtcaaaaaaaggcattatgaaaaagttgcctaaacagaatagaaaaagaacattcaagattggttatcacagcatgacctaggcaggataggagttgaaagcctaattaatgttaaggggatatttatattttatttagagaagaagtaatgtggtaagcttttttgatatgttgcatgccatctaagtgtgtggaatttatcctggagcctcttacatatttttagaagagaatgaataaattcaaaacaatatttaagattattgcaataactctctatagttgctattctcattattcgtatcagcaaccacaaagtatgctatagtaactaggctattaccatgcagccatcatttataggcaatcataaaaatatataaacaccaattaccttttttatcttcaaatgatactatatcacctcatgtatagaggtgtatattatatcacctctatatcacatgaggtgatatatgtatgtatagaggtataatataatgtatagaggtatatataatgtatagaacctcattacaatttatttctattttgtccctcctgtgctactgttgtcatacatgttatatttatatatgttctgttccctgcaatttattattttttctttagtcaattataaattataaatttataaattctacttacaaatttataaattaattataaactataattgactatttaaagaaaatttaaataaaagcttttttatatttacccacatagtcaccactttaaattttctgcattctttttgtagttctaaatttccatttggtattattttccttctgcctgagggtcttgctttaactttttttttttcttttttttttttttgagatggagtctcgccctttagcccaggctggagtgtggtggcacaacctcagctcactgcaacctccacctcccaggttcaaccgattctcctgcttcagactcccaagtagctgggactacaggcacccgccaccatgcccggctaattttttttttttttttttttttttgtatttttggtagagatggggtttcactgtgttagccaggatggtctcaatctcctgacatcatgttctgcccgcctcggcctcccaaagtgctgggattacaggcgtgagccaccgcgcccggccttggctttaacatttttatagtgcaggcctgcggctaatgagcttttctatgtctgaaaaagtctttcaccttcatctttgaatgttctttcccctaaactctagcttggcagttttagctttcagtactttaaagatgttgctccactacagtgttgctgatgagacatctgctgtcattttatctttgttcttccatgtatgattgatgtttttcccctctggctgattttgatttttctctccaccactggttctaagtaatttgattatgatatgcttcagtgtattttcttcatatttcttattcttggggttcattgagcttcttgattcattaccatataattttcattaaattttggaaaaaattttttgttgtcgttttttgtttttttgtggtttttttgagacagagtctcactctgtcacccaggctggagtgtaatggcgcagtctccactcactgtaacctccacctcctgggttcaagcaattctcctgcctcagccttctgagtagctgggagtacaggggtgcgccaccacacccagctaatttttatgtttttagtagagacgggattttgccatgttggccagactggtctcaaacccctgacctcaggtgatctgcccacctcggcctcccaaagtgctgggattataggcgtgagccaccacacccggccaaattttggaaaatattgatcattatttcttcaaataatttttgtcaccatccttattcctctccttcagagacttcagttgcatgtatagtgcacttgaaattgtctcacattcaccgattctctaggtttgggggctttcgagcactgggatgaggttcagttatttttttctttgattttagaacatttatattactgtagcctcaggttcactaattctttattttgcaatatctaatctgtttatacagtgtatttttcatctcagacatagcagttttcatatctagcagtcatatttggatcctttttatatcttccatatctccaacatttttttcatatctgttcagcctttcctcttatttcttaaacaaatggaatatggttattataattgtcctgatatttctcacctatcagttctattatcagcatcatttttgaattgatttcagttgacttcccttttcattatgcatcatatttttctgcctctttgcatgcctggtaattttttattggatgccagacatgaattttaccttgtttatattcctacaaatattcttgagctttgttctaggaaatggttacttggaagtttgatccttgcttttttgtttactgcgaccaaagcagtattttttctagggctaattctaaccttaccaccaaggtaaaacctttaatatgctacatgatactacatgaattacgatgttttccactctggggggtgaaatcagggcttattcccagccctgtggggactttgggaattgttccatgtcatctattcaggtgattgtttcccctgcatctataagctgattagtactgagcttcagacttgagggccactgcagatctattccagagctctctctgatattctgctctgaggattctagctgcatccccttaactcagggagcctgccaggcgctgcctggattccctttgtccatgatacagccggaaatacactccaggcagtaggctgggcggttgccacagtagggactgctgaactgttagggatcactgtccttcgttgcctttgtctaatgtcttcagtgcctttttttcacatattttgtcaatttttttagctgattgaggcaggaggataagtctgatccctgttactaaatcttgaccaaagtgtgagtctaccactaattaacatatgtatgtgtgaattaactttttattaaagtatcatatataagaatatagagaaaagtgtacaactcaatagattttcacaaagtgaacacacctgagtaccactcagatcaagaaacagaatgtcatcagtaccccagaggttctccttgtgtcccttacacactcactaccccacaaggggaatgactatcctgacttgtaacaacacagttaattgctaagcttttcatttttgctgtgctcctattacttttctgtcagtgagattgtttttcattggagaatttggttttcagtttaaacaactagcttgtaatttgatcttgtatttatctttaatagataaatgatcccgcactgagacacacaggcctctactgcaaccagctctcatccactgaccttctcaaaacagaagcagatggaacccaggtcagtaaggaaattctaagcccagagctgtcaaatgtactctagatgcacagaggtcattgtgtagcatcattaagagcctgaccttgggagtcagacctgggtgtgagtcctggctctgctcttcttagctgtgtcgtcctgggcatgttatggagctttcctgagctgctgtataaccacagaactaacatgacacctgcttataggattgttgagaggattcaatgagatcagttcagatggcttaactcagtgcttagataggataaagtgatcacaaatggtggccactaattgttattttgtaaataagcacagtgctaaaaactcatctgtaatcaaaatacctcagaagatctcagtaattcagacaaaacagagtacctgctgtatacttcacctcctaagaagtatgtttcaaaacagcacaaacagcaaggtggccactttcctatattaacctaatttagaaattgtgggccgggcgcggtggctcatgcctgtaatcccagcactttgggaggccgaggcgggcggatcacaaggtcaggagattaagaccatcctggctaacatggtgaaaccctgtctctactaaaaatccaaaaaattagccgggtgaggtggcgggtgcctgtagtcccagctacttgggaggctgaggcaggagaatggcatgaaccccggggggcggagcctgcagtgagccgagatcacgccactgcattccagcctgggcgacagcgagactccatctcaaaaaaaaaaaaaaaaaaaattttggaggaagggcttaattcactttcgtaactttggttgaactttggtctctctctcttttttttttttttttttttttgagttggaatttcgctcttttgcccaggctggagtgaagtggcgtgatcttggctcactgcaacctgcgccccctgggttcaagcgattctcctgcctcagcctcccaagtagctgggattataggcgcccgccaccatgcccggctaatttttcgtcttttcagtagagacaggttttcgccattttgaccaggccggtctcgaactcctgacctaaggtgatccacccgcctcggcctcccaaagtgctaggattacaagcatgagccaccacgccaggccagactttagtctcttaatgaacatttttaacccagggattatgccacagatggcagtaggaagacacataagatatgttccatcagcatctggtgaactgtggggagaagtgaggaaaggaaacttcatttgtgaaatgcttgtggtttgccaggcactgtgctatgcactgtatgcattatctcatttaagcctcactataaccctatgaacgaggtagtattccttttcttcacagatgaagaaactgaacatgaggaggtttaactacatgtaccattcacagtgctagaaagaggaagagctgaggttcaaacccaggtctttctaccgccagagtccacactgttcctgccataccagttagggactgctgaaagataaaacacatcaatatatgcacctaaactgtcataaaaccaaagaaggcaaattattaaatttatgttacaattaatgaaccataagcattcaaagaaaggagaatttgctgagatggtcacaagagcatttttgcaagagatagagctgagctgagccttgaaggacagttaccaaggcaaagggaaggaaaagggtatggtagttgttggaggctggtgcagaggtagatttagaagtagaaggaactggaaggccacagaaacagggaaatagtaatatctcaacatagtcctgggaaaccaaatcaactgaaggtaaagggtttataataagtattcataggaattaaaattggtaaagtggcttggggcaaatttccagaggccttgaatgctaaactgagggatttggattcaaccctatggacagaagagtcatccctgaaagggaacatcgatagaagtgctagtttagacttcatcttgggaagaaggtgaaggaagatatattggccagttgagaaggacaaagattagaagactgggttcacagtctaagcattaggaaataggacctgagtcctctcaaggtaaagagaaggcattttggcttacacctgtaatcccagcactttggaagcctgaggcaggcaaatcatttgaggtcaggagtttgagaccagcctggccaacatggagaaaccctgcctaaaaatacaaaaattagccaggcatggtggcgggcacctgcagtcccagctattcaggaagttgagacaggagaatcgcttgaacccaggaggtggaggttgcagcgagccgagatcacaccactgcactctatcttgggcgacagagggatacttcgactcaaaaaaaaaaaagagagagagagagaaggcattttaagactggggagccgggtgcggtggctcacgcctgtaatcccaatacttcaggaggctgaggcgggcagatcactaggtcaggagatcaagaccatcctggctaacacggtgaaaccgtgttaaaatacaaaaaaaaattagccaggcatggtggcgggcgcctgtagtctcagctactcgggaggctgaggcaggagaatggcgtgaacctgggaggcggagctggcagtgagccgagatcgtgccactgcactccagcctgggcgacagagcaagactctgtctcaaaaaaaaaaaaaagatcgaggaaatgaagagtcttcattcaccagatgtttttgaaagtctcaaacccacagagacattactgggcagcttgacaaattagttacacccaaacaaccatgttttaaagttccagagccctgccctgaaacagtatttgaactgaagcaaaaattatgccagaaaatcttcagaggttgggactcagctctcacaccagtcttctcacctggaagatctgaagcttcttttgtgtcacactttgcctatctgagaagttgtgacaatataagaagtcctttgtggactggtctgagacacccccttttaagtaatagtttgaaatgggttttagagtttgttcagtcttttcagttttctgtaatttcaataatacactttttttttttttttttttgagacggagtcttgctttgtcgttgcccacgctggaatgcagtggtgcaatctcagctcactgcaacctcctcctcctgggttcaagtgattctccagcctcagcctcccaaatagctagaatgacaggcgtgtgccaccacacccagctaatttttttattttttgtagagatgggtctcactatgttgcccaggctggtctcaaacttctagcatcaagtgatcctcctgcctcagcctcccaaagtgctagaattagaggcatgagcctccatgcctatcctagactatcttttaaaaagttttatttttaaagaagcagaactttctagtttgttttatcatgcctttatcaagaactttttaagaatttagggacaaaaacatcttatgctctgccccaatatttcatatgtagaaacataaacatcaaattttatatgttgacctttttttaaatcactgcctaaaaaagaactatattttgtggtcatgtgaagtttcagtggtagaattttctttctgttgtggccaatcatgaatcttgctccagtgtttttgtatttaccagacggcagctggggagtgagttagacagaaatataaagacagatatacagaaagggagaagaaaaagatgaggagaagaggactaggggagtagtagggaactgggatgggatggggaggaggtaagacaggagagaacaggaagagaacagaggagtgggaagagggatggcaggaggaggtaagacaggagagaacaagaagagaagagaggagcgggaagagggctggcaggaggatcgttgacctaggaagagaggaaggcctggtgaagctctagaaggaaagagtcagaatgagacgttacagaccacaaaggcggggcaagggcacagaggcagctggagagcagactgggcgcgttggtgtgttatagacacaagagaaagagcccagaggaggcagtaacaaatgggagcatataggagctagaagccacatttgggaaactagggaaaggggaagagaaggagagaaaagcagtgcaaatctaactagagatttgattccttaggcactaggaaagctcagcttgggggctgtctgcctcatctgagaggaaggaaagtggagatataaacggattaagaggataggagaccaggggacagactggtgtccaaatttgatgcataccacatttgacatttggctaatgaaggttgatggaaaacaacttttactcgattaggatagaaaagttttttaaaaagctgagtgtaattgacatgaattagtgataaatgaccaaaaaaaatacaccactaatctaaaatactttatgacctatcaaacaggagacacaagtttgtcaaaaagtttgagacacttagatgcacttagatgccttagaaggcatctccattcctggtctggaacattcacaagtgtggtattggccctaatcagttctacgaacaactttttaataaggctggttggtaaagactaacttctggctttgttttcccaatagaatatgctagaactgtgcaactttagacatttttaaggaataagtgtattattactcatagtagtgaagggaaaattcacactgttctcaaggctaatagacgtactgttaattttagctcatgtgtttaaatggattgtctatcaggggaaaaaagtcaaatatgaaattgttctaatgataatttgctgtaattctaaagccaatatgtgaaagagctgtgtaataatatatttaaatactaaaaaatcttttggacattaaccttagatgctgatgtcctcttattgagttgtggttttgttttgctaatactggttgaaagccctttaatttttcagtgacatcataaagattttttatcctactgaaatcatccatagaatggttttaaaccagttttctaaatatcatgtattttttaaaacctaccactggatacccagactctgaaactgggcttctcccaatcttggcaacattagcaatgatactcactttcagtattgatggcaaccctataggaggcgtgaccattccaattttgattttatttttaaagtgtgaactttccagaaccctgagcaaaatgagtgcagcgattttctttttgtaggacaagaagacagaagagttcttctctgtggtgactacagactagaggaatgctctagtgagtttccacttcaagtagtacccactcataagccgggggggcagacccttctgtctaaacacatcttttatttgtgttccagcaggtgcaacaggttcaggtgtttgctgacgtccagtgtacagtgaatctggtaggcggggacccttacctgaaccagcctggtccactgggaactcaaaagcccacgtcaggaccacagaccccccaggcccagcagaagagcctccttcagcagctactgactgaataaccacttttaaaggaatgtgaaatttaaataatagacatacagagatatacaaatatattatatatttttctgagatttttgatatctcaatctgcagccattcttcaggtcgtagcatttggagcaaaaaaaaaaaaaaaaaaaaaaaaaggagtttgcttttgtcgggagattgaaagatgtttttgtttctttctttgtaaaggccttggatattgaaaaaataccaaggcagaacagttggacaatctatttcttgagccaaatttaattattcttatttttgtaatcagtcattggcttcttatctggatgaaggcttttggaggagaaccaaaacgacaagttccaagaagaagatgaagctccgcctccgccgcttagtcccaaccctgcccaggaagaagggcccgtggggctttgcctgtgcccgtccaccaaaggctgtcatgtgtctcgaaatcagcagccctccccatcccaatcccaggcagcttgtgtgtacaatcagcttctctagcaactctgtatctgttggcttcaagagaatattttgcctccacatatgtaccccttctcctttttttaaagatggatttaaaccaagatgcctccaggaaagaggacgaaatgagtatattcacagaggaatccaaaaaatacagtttgggggaaaatgcaataatttttgatgagatgggtgaaggacaagaagtgagttgtgtcaattattgtagatacaattttctgattaaatctggaaaaataaaaggcagcctgttttttctgcttttattgtattaacagctgaggtagctaaagttatttaaaataaaattaaatttatgatccaagtagcttatttttccctttaaatctcattgtaaatatatttgatttcttgtagaaattgatttccttctgtttaattttatgcttttattatactcttgatttttctaaatttgtgtgtgaaatataacattgattgaattgcagttacatttggttagtaatatttcattattttaataactgtgatgtcatgtatggatttactttggggttcaaatcaaaatgtcactgccagaaagagctgttccagctgatctagagcatactgccctagagtgtccctgggatcatctgaacagaagtgcacaggctacttgtacagagaaaaaattaatactcaaaggaaatcttcattttttagattgactttgggaatttgaattttcatcagtgcaaatataaatttctctatcctgctctgaggctaattggtaccatattttccctttgtgtcttgtgactctgccacatcccatctcatcctggcctctgagtcaagaacccagtgaactgactttctagttctagaagttccgctgcaaggccaggaaagcttgagaaaggtattgtggaagaagcaaaggtagacccccatcactcacctttgtctgcatccctgggcctgtgaatgatgacagcacctgacattctgcaccagctacctctgcctccatggcagagaaaaggccataagaacagtggaagaggagcatggactcagacttcaaggaagaagccatttccccaggtccttccttctgcatctcaccacccctagttacaaataactccattgaacagcatctattcagaaactatgccgaataaaaagattggtggaagggctcatgtggttagcaactatgaaacagaaataggacactcagttacaaacattatctcctttagtttttcagaaaatgcatccctgatttcattcatttccagcttgaaagccagccatattactctagtccctaccaaactgctctagaaggtcatttccattttgtttgtgatatttagacgcgcagacttcaggaagttcacctttaacttcagcattccagatgaagtttcctgactcagtgcttttgcataaggaactagaaaaaaaaagtaaggaaaattggagatgctaacatcctcccccatcccaactgcaccttaaaatatgcatgtcaccttcaaggttttataattgcactgtttgttttatgtatgtacagattaaaattattgctacatttgaggaaaataaaattgcttgcttctatgtaattcctgtcattccacaggaaattcacttttccagctactgaatagaatttgtttaacaacctcatgggttgcctcttcatttacagggaagaaatgaaatgtacatctgcagaaattgccaaagcccaaattaacgagtattataaaaggataataaagcatccctgaagccaa

SEQ ID NO: 139 - DNA, 186225 bp, Homo sapiens; identical to SEQ ID NO: 138

SEQ ID NO: 140 - DNA, 186225 bp, Homo sapiens; identical to SEQ ID NO: 138

SEQ ID NO: 141 - DNA, 22208 bp, Homo sapiens
ttgcactttcctttcactttctcaggacgccaaacccgacacctggggccagaactacacttcccaccaagcagcgaggcaggaggaagaagggggcactggggggctgaaaagcaaacccagaagaaagcgaaaacattacctgctgaccagcagaggtgagagagcgagacaggtaagcgacaggtgaaccaggaaggcgaaggctgcgggatgccggcgggaggacatcatcggggtggacgctgcctgtgcctcccagcaaggcttgtaggctcaatgaaagggggctttagtggaaaccctgaggactcctgagggtggggggagacatggaagtaaagtctcagctcaagttacagtgataagaccaagacaccggaagtggaatggctgtctttagttgaaaagtcagacaggaaaaaagtggtttgattgtgtctgttgtctgctggatcatctacccatatgtgatttcagagaggtccaagagaggtatgggatccttcttcatcgccttaaagccctgggtttttgcatgcagattggacatttgagtgcattttaccttgtgtgatgagacagagtgtccttgtctatgactttagagaaaaccaaagtaaaacggagaggtgaagaaggatgtcacaaggcaggggcaatttgcagcacatcaaatgtaatcattaagtgggatcaggtttcagttacttttagagcaattggatgaggagtccgaacacactctcaggaagaacagttaaagaggatggggatattctccttgggggaatattcttgctgcttcaaatatctgatgggctgtcatgtggaacaggaatgtgatgtgtcttggcagagtaaggatagcacggagctagacagatggaaacctcatggagggaggtgtcaatcccacagaagtgagagctgcccagtgcaaaatggaaatttttcaggaggtagtcagttccttgtgatcagagatatttaagcataggtggacatttaagccagggatgctgatggtgggagtaagtttcaggtaggtgacttggtcgattggtgttttccaaacctggctcatcatcagaatcacctggggaagagacagagcaagaggggaggggaggggagggaagagagacagaggtttttggttttgtgtttttgtttgtttgtttgtttgttttttgaaacggagtttcgctcttgttgcccaggctggactgcaatggtgcgatctcggctcactgcaacctctgccctctgggttcaagccattctcctgccttagcctcccaagtagctgggattacaggtgcatgccaccacgcccggctaattttttgtatttttagtagagatggggtttcaccatgttggccaagctgatcttgaactcctgacctcaagtgatccgcctgcctcagcctcccaaattgcttggattacaggtgtgagccactgcccctggcctatttcttattattttaatagagatgggcggggagggggggcgcagggctctcattatattgcctagactactttcaacctcctggcgtcaagtgatccttctgcctcggcctgccaaagtgctaggattacaggcatgagcgactgcggcctggcgcactaaacatattttaaagttaaaaacacaaaacacaaaacctggcccagtgcagttttgagatcataccactgcactccagcctcggtgacagagcgagactctgtctcaaaaaaaaaaaaaaaaaaagaatactaagaaataatttttaaaagaacaaggtaaaatatgtttagcaagtctgggatgagctccaaaaatatattttttcaatgatattcccagataattctgataatcagttagtttgtgaaacactgtcattaaaaacctttattttccagccgggcatggtggctcatgcctgtaatcccaacactttgggaggtcaaggcgggcagatcacctgaggtcaagagttcctaaccagcctggccaacatggcaaaaccctgtatcgactaaaaatacaaaaattagccaggcgtggtggcaggcacctgtaatcccagctacttgggaggctgaggcaagagaatcgcttgaacccaggaggcggaggttgcagtgcagtgagccaagaccacaccattgcattccagcctgggcaagaagagtgaaactctgtctcaaaaaaaaaaaaaaaaaaaaaggaaatatatatttttcaatgatactctcagataattctgataatcagttagtttgtgaaacactgtcattagaaaccttaattttctggcggcgcgtgatggctcaggcctgtaatcccagcactttgggagactgaggcaggtaaatcacttgaggtcaggcattcgagaccagcctgaccaacatggtgaaaccccgtctctactaaaaatacaaaaattacctgggtgtggtagtgcaggtctatagtcccagctactcgggaggctgaggcaggagaatcgtttgaactggaaggcagaggttgcagtgagctgagatcatgccattgcactccagcctgggcgacacagcgagactctttgtctcaaaaaaaaaagaaaaaaaaaaacctttggtaaaatatgccataaccagcctttggtaaaatatgccataacattatagccatggttttaattttgaatattctcaaaatcctaatttcctggtcaaaaaaattaggctccaaacagaacaaaaaggtcatgtcactcttccccaagctgacttaccaatcacctcttatcagtcctcgttgctagctacctggatggtcagtagttttttgttttttgggtgttttttttttgaggtggagtttcgctcttgttgcccaggctggagtgcaaaggcatgatctcggatcactgcaacttccgcctcccggattcaagtgattctctggcctcagcctcccgaatagctgagattataggcatgcgccaccacacccagctaactttgtatttttagtagagatggggtttctccacgttggtcaggctggtctcaaactcccaacctcaggtgatccacccaccttggccttccgaagagctgggattacaggcatgagccatcgtgcacggcctggatggtcagtcttacagcagttgggaatctttctccccaggtgaaattgacactagtgggacctccaatggcaggtgagtcactgctgtgggcatttcctctgccattctcctgctctccgggcactctgatggagcatgtggcacctcgtctccaggcctaggatatatcactgcttttatctgatggtgttgaccgtccactggacccaccagagaatggcagtagaacctctttattccaagagcacccctaaagtaagatcaacacacgtagggcagatgtcagcttatggggacaactcctctgtgcccgactagcatcattagcatcgtcctctcacaaggatgtagcactgtgaaggtaatgacctcccttcgtcttgtcttgtactggatccccagttcctggtgctgaattccatcctttcttcctagttctgttctaggtggcaagaaccatgcacttctccagctcagccagggcagcagatgagaactttgactatttgttcaagattatcctcattggggattccaatgtggggaagacgtgtgtggtgcagcatttcaagtctggagtctacactgagacacagcagaacacgattggagtggactttaccgtgcgttcccttgatattgacggcaaaaaagtgaaggtcagagggcaccgggacgggactggttccaccttttttttttttttttttttttttttccttgagacggagtctcgcgcgatctcggctcactgcaagctccgcctcccgggttcatgccattctcctgcctcagcctccagcctcagcctcccaagtaacaggaactacaggcgcccgccaccacgcccggcaaattttttttttttttatgtatttttagtagagatggggtttcatggtgttaccaggatggtttctatctcctgacctcatgatccacccacctcggcctcccagagtgctgggttacaggtgtgagccaccgcgcctggccagttccaccttttttagccagaattcccaacaacaaagcacatgtctgagcaataaaagatttcagtacaaaacatgaaatcatacaaatagtggaagaaaacatgggagtatttattttctcatcatggaatgggaaaatcaggctttaaatgagacacgaacccagaagccaataaggaaaatactgctgaatctaactgtgaaggtcaaatttatacatttctctaactatataaaggtcaaatttgcttttttgggggggtgggggagtgtagacagggctttttgtttttgtttttgttttcttgaggcagagtctcactccatcacccaggctggagtgcaggagcacagtttcagctcactgcaatctctgcctcctgggctcaagcaattctcatgcctcagcattccaagtagctggatttacaggtgcacaccaccacaccgggctaagttttgtatttttagtagagatagggtttcactatgttggccagactggtctcgaactcctgacctcaagtgatccgcccacctctacctcccaaagtgctgggattacagatgtgaaccaccacacccagcctgagacagggtcttgctctgtcactcaggctgaagtgcagtggcacaatcacagctcactccagcctccatctccccgactcaagcgatcctctcacctcagcctcctgaatagctgggaccacaggtgcaccccaccatgcccaactccttttttaaatttgttgtagagacaggattttcctgtgttgctcaggccagtctcaaactcctgggctcaaacaatcctcccacttcaccctcccaaagtgccgggattacaggcgtgagccaccaaacctggccttaaaaggtcaaattttctagtggccaggcaaggtggctcacacctgtaatcccagcacttcgggaggccgaggcgggtggatgacttgaggtcagaagttcaagaccagcctggccaacatggtgaaaccctgtctctactaaaaatacaaaaattatccaggcatggtggcgcgtgcctgtagtcccagttacttgggaggctgaggtacaagaatctctcaaacctgggaggcagaggttacagtgagccgagatcatatcactgcactccagcctaggcgacagagtgagactctgtctcaaaaaaagaaagaggtcaaattttctgtgtactcaaaaatgccataaactgccaggcacggtggctcatgcctgtaatcccagcacttttggaggccgaggcaggcggatcacccaaggtcaggagttcaagaccagcctggccaacggggggaaaccccatctctactaaaaatacaaaaaaattaaccgggcgtggtggcacatgcctgtaatcccagctggtcaggaggcttgaggcatgaaaattacttgaacccaggaggcagaggttgcagtgagctgagatcacaccattgcactccagcctgggagtcagagcaagactctgtctcaaaaagataaaataggctgggcgtggtggctcacgcctgtaatcccagcactttgggaggccgaggtgggtggattacgaggtcaggagattgagaccatcctggctaacacggtgaaaccccgtctctactaaaaatacaaaaaatcagccgggcctggtggcgggtgcctgtagtcccagctacttgggaggctgaggcaggagaatggcgtgaacccgggaggcggagcttgcactgagccgagatcataccactgcactccagcctgggcaacagagcgagactccgtctcaaaaaaaaaaaaaaaaaaaagataataaataaaaatttaaaaaattaaaaaatacttcaaagaaatcaacagaaagggctagatgaagcaagtaacaaaatctcattaattattgaatctgggtgataggtgtatgaggttctttttttatgtttttgagacagggtctcactttgttgcccagatggagggcagtggcgcatgatctcagctcgctatagcctcgacttcctgtgctcaaggaatcctcctgcctcagtctcccaagtagctgggactacaggcatgcgccaccatgcccagctaatttttgtatttttcttttttttttttttttttttttttgagacggagtctcgccctgtcacccaggccgaactgcggactgcagtggcgcaatctcggctcactgtaagctccgcttcccgggttcacgccattctcctgcctcagcctcccgagtagctgggactacaggcgcccgccacggcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctttttgtatttttcgtacagatggggtttcaccacattgcccaggctggtctcaaacccctgagcttaagcgatccgccacctcagcctcccaaagtgctgggatcacaggcatgagccactgcacccagcctcatttttctattatctctagctttggtgtatgtttgcaaactttctctaaaaaataaattttatataaatagtatgagaatatgaagaaattgctaccctcagacactgtgagaggctgtgtgaattggtgctgccgcttgggtggctaatttgggaggtattattgtgagaacattccaaacatgaacagcttgagtgttcctttaaaatcagaacagttcggccagtattatcacctttgccagtattcagatccacgggcagactcaaaagatgagcccccaaatctggaccaagtgatgagtcaggagaaaaggcaaagaacacaagaccccaggataaaataggcccacctctcggccgggcgcagtggctcacgcctgtaatctcagcactttgggaggccgaggccagcagatcacaaggtcaggagatcgagaccatcctggctaacacggtgaaaccccgtctctactaaaaatacaaaaaaattagctgggcatggtggcgggcgcctgtagtcccagccactcgggaggctgaggcaggagaatggtgtgaacctgggaggcggagcttgcagtaagctgagatggcgccactgcacgccagcctgggcgacagagcgagactccatctcaaaaaaaataggtccatctctctgacagcagcatcccttaaatcggctgtccaagcttctggtttccctgggccatgttggaagaagaattgtcttgggccacacaaattacactaacactaatgatacctgatgagctaaaaaaaaaaaaaatgcagaaaaactcataatattttaagaaagtttgaaaatttgtgttgggctgcattcaaagttgtcctgggccaaatgtgtcccgtgggttgcgggttggacaagcttgtcttagatggtcgttccccaaccaaggaggatatccaagtcatccagggagcaactgaaagaatagatccctgggtcccaccccagatctactgggtctgaatatctagaagtgagacccagaaaactgtgtttttaagaagatgtaggtgaaggagttcccattacctgtgggaacccctgatttggactctccttcctgtccttctccagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggtatggcatttttgaagtttttaacttttgtttactctcctctgaggatgctcagctttctgcatgtttctaatgacagtggaaaatgaaatcttaaaagtgtaagtgatgcagccgggcacagtggctcacacctgtaatcccagcactttgggaggctggggcgggcggatcacgaggtcaggagatccagaccatcctggctgacacggtgaaaccccgtctctactaaaaatacaaaaaaattagacaggcgtagtggtgggcgcctgtagtcccagctactcgggaggctgaggcaggagaatcgcttgaacccaggaggcagaggttgcagtgagccgagattgtgccattgcactccagcccgggtgacagagcaacactccgtcggggggaaaaaaaatgtgtaagtgatggatagggcctcagaaagtgcctttaagctggatgccaccatgcccagcccatttttttttttttaattttttgtaaagacggggttttgccatgttgcccaggctggtctcgaactcctgggctgaagtgatccccctgcctggccctcccaaagtgctgggattacaggcatgagccattgtgcctggccctttatttttatttttgacatctctactgcagagtgaacaggtgagttttgttttttaattttttatgggtatctagtaggtatatctatttattgggtacagtgggttcttaaaaagaaagaagaggcaatttctaagtgtttaccaataatttacattaaaatacataaacatagatggggcgtggtggttcatgcctgtaatcccagcactttggagggcgaggcaggtaaattgcttgagcccagggtttcaagaccagcctaagcaacatggcaaaacctcatctctacaaaaaataaaaaaaattagctgagcgtggtggtgcacacctgcagtcccagctactcaggaggctgaggtgggaggattgcttgagcccagcaggcagaggttacagtaagctgagactataccattgcactccatatgggtatccagttttcccagcaccacttattgaagagactgtcctttcgccaacatatgttcttagcacctttgtcgaaaatgactttactgtagatgtatagatttatttctggattctggattctgttccattggtctatgtgtctgtttttatcagtaccacactgttttggttaccatagttctgtagtataatttgaagtcaggcaatgtgattcctctaggttggttctttttgctcagggtagctttgactattctgagtctttcatggttccatataaattttaggataatcttttctatttctgtgatgaatgtctttgggccaggcacggtggttcatgcctgtaatcccagcactttgggaagctgaggcgggaggatagcttgagaccatcctggtcaacatagtgagacttcatctctacaaaaactaaaacaaaacaaaatagtgagatgtggtggcacaggcctatagtcccagctacttgagaggttggggtggggggaatcacttgagcctgggaatttgaggctgcagtgagctgtgatcataccactgcattccagcctgggtgagaaagcaaaacctggtctcttaaaaaataaataaataaataataaaaggcaactgttatgtcctagtagagcaaagatgggagagctgtgccatggcatacaaacggccggggtggacaggtagatgcagcccatgccctccagggacaaaaggaaacccagcaatggtggctcccagagaaaggcggaatgcacgcatctcacttgggaatgaagcagttctaagctacatgcggtttccccaggaatgtggaccagatccacctttgtattaaggtcatgcatctcgaggacacagtggaggcagttcttcctcagggctgagtgggaagctgcccaacctcagatgcctccctctgtgctaccttctctctttttttgagacggagtcttactctgttgcctaggctggagtgcagtggcatgacctcgactcactgcaatctctgcctctcgggttcaagcaattctcctgcctcagcctcccaagtagctgggattacaggctcccgccaccacactcagctaatttttattttagtagagacaggatttcaccatgttggccaggctgatctcgaactcccgacctcagatgatctgcctacctcagcctcccaaagtgctgggattacaggcatgagccaccacccccggcccctctgtgctatctctgaaggcagcgacctgtctccagcccacaggatcccagctgcctctcccccagccagctccgtctttaatcactctgtgaaacagatgcatcagagaagggtgacagatgccaggatgttgcaggatttccaggaatctcagaatgtttgcttggtatttataccctagtctgtctttcataacaagcatctctgcctcacttcttccttggttctagaaatgcccccaaagatgatttggagtgtcctagtctcccagtttataaggtgtccatgccagagggctgacacagcagccttcctgttttctgttcgtggcctccctgcctgaatccagaaaaattcgtgttgtccctcacggaagtgtcccggcacacattgcctcatacacgtgcttctttctgtctcagaagtttatccccagctccttgaagccactttatcagcacaggaatgaccccggtgtcaggggttgattgcatgttgatttatacagctgttcctcctctagctggctacagggggcccagctcctcctaatgtccccatgtaaaaccctcagaggcccccatttcccttagaatgatgtacatattcctgaacatggttcacaaggtacttcaggtcccagccctgctttcttctgggggtgtctggcttcccatctttctcctaccctcactccatcagacctgacctctttttttttcttttcttttcttttctttttttttttgagacagggtcttgctctgtcgcccaggctggagtgcagtagtgcaatctcggctcactgcaacctccaccacccgggttcaagtgattctcctgtctcagcctcccaagcagctgggattacaggcacctgccatcacgcccagctaatttttgtgtttttagtagagacagggtttcaccatgttggccagactggtctcaaactcctgacctcaagtgatccacacacctcgcctcccaaagtgctgggattgcagggagccaaccttttttgtaggttatcctggatgctctgtctcataactttcttcaacatctgatatttgtccctctaaagatctcagccaaactttccacttaaagtcctgttatattacaggtccacaatcactcaacaaaaaccctcagggccaaatatttcagagttcagaatttgtcagattttagaaaaatgtactctgtgttacataacaccctcagcagggtctgggccaatgccgcatggccaaatacattactatttatgcagtcagatgtgtaaatagtcatacagagcaggttgaataaaatcttcaatgctgggcatggtggctcatgactgtaatctcagcactttgggaggccaaggcgggcggattattttgtaataaaaatacaaaaattagccagatgtggtggtgcacgcctggagtcccagctactcaggaggctgaggcaggagacttgcttgaacccgggaggcggaggttgcagtgagctgagatcacaccagtgcactccaacctgggtgacagagcaagactctgtctcaaaaaaaaaaaattattcaagccaggtgtggtggctcacgtcagtaatcccagtagtttgggaggctgaggtggggggttgcttaaggccaggagttcaacatcagcctgggcaacatagcaagaccccatctttatttttatttttaaaacaaacagccgggtgcagtggctcacgtctgtaatcctagcactttgggaggccaaggcgggcagatcacctgaggtcgggaattcgagaccagcctgaccaacatggagaaaccccgtctctactagctgggctttgtggtgggcacctgtaatcccagctactcagaaggctgaggcgggagagtcgcttgaacccaggaggtggatgttgcagtgagccaagatcacaccattgcactccagcctgagcaacaagaacaaaactctgtctaaaaaatcaatcaatcaatcaaacaaaaaaaaacttcaaatagctagtttagctcagattttactgtcaaatgaattatcaagaaatgcactggttacagctgcccaggagtggagtttcagagtttaggggatttgggggttgtataccagtactacaaacaactcatgcagctcaccgggtccatagcatatgttattttattgctgtcttggattggtacattcttgtctggccatttaatgttctgtgtgtctgtcttgcctccctaacaaaatgaagaagcccttccttggggcagggccgtctgtcactgtgcacttagcaaacttcagatcctttcccttcctccaggcacctggctcaccccagagtgtgcagccctggctgttggcgggtggacccgtggacatcagcactgttgatctagttgtggtggaggagcaggtggaaggagcaggtcataaaagttagaatccagctgggcgccgtggctcacacctataaatcccagcactttgggaagttgaggtgggaagattgcttgatgccaggagcttgagatcagcccaggcaacatagtgagacctccgtctctacaaaaaataaaaaattaagccgggtgcggtgactcacacctgtaatcccagcactttgggaggccgaggcaggtggatcacttgaggtcaggagtttgagaccagcctggccaacatggtgaaaccccatctctactaaaaatacaaaaaaaaaaaaaaatcagccaggtgtggtggtgagtgcctatagtcccagctacttgggaggctgaggcacaagaatcacttgaacctaggaggcagaggctgcagtgagccgagatcgcaccactgcactccagcctgggtgacagagcgagactctgtctcaaaaaaaaaaaaaaaaattagctggactcagtggtgtacgcctatagtctcagctactctggagactgaggtgggcacattgcttgaggctaggagttcaaggctgcagtgagctatgactgagccactgtgctccagcctaggtaacagatggagaccctatctcttaaaaaaaaaaaaaaaatcaaatccacagatggagtgggatgcagggagtagatcagattcctggctgcaggggttccttttcccaccacatcccttcttccaccagggactgtcattcctttcttctagaagcagagctcagcccagagcttcaggctcaccagctaaaaacacacgcatggttctcttgaaggtgcatgctatacgagcttcctgtggctgctgtaaccaactgccacgagctgggggctgaaaacaacagatgtgttcacccactgttctggaggccacaagtctgaaatcagtcctgcggggctgaaatggaggtgtcagcagggccgtgcccctctggacgctgtaggggagactgtccctcgcctcctctggcttctggtgccatctttggctctgtgtgcctcaccttttcctgcctgtgtgggatcaagtctccctctacctcccccttgtaaggttacttgtgattgcattcagggcctgcccagctagtccagaataatctccccatctcaagatcctcaaattaatcacacctgcaaagaccctgttagcattgacagctgcctgaggccagagcctggtctccatgggcccccgttcctagcctattgtagcactcaaatgtgctaatgtctgctgaaaatggtcttggatttaaacttctttggggatcattatgatctaagtccagctttgacactgggcaggttggtgacagtgactatgggaaaagattttcaaaatattttttattgggacatattaatgtatataaagaaaagtacacattaatttatctcaaagggaacagctgagcaaacaccagctgggtcaagacagagaatattggccaggtgcagtggttcacacctgtagtcctagcactttgggaggctgaggcgggtggattgcctgagctcaggagttggagaccagcctgggcaacatggtgaaaccccgtctctgctaaaatacaaaaaaaaaaaaaaaaaaaaaaaaaattagccgggcgtggcagtatgcacctgtatgtagtcccagctactcgggaggctgaggcaggagaattgcttgaacccgggaggcagaggttgcggtgagccgagattgcgccactgcactccagcctgggtgacagagacagactctgtctcttaaaaaaaaaaaaaaagaagaatattgactgggtgtgggctcacacctgtaatcccaacagggatttgggaggcagaggtcggaccagcctgaacaacatagggagacccgatctctacaaaaaaattacaaattagctgggtatgatggcatgcgcctgtagtcccagctacgcaggaggctgaattgggaggattgctttagcccaggaggtagagtctgcagtgagctgtgatcacaccactgcaccacagcctgggtgacacagtgaaaccctgtctcaaaaaaaaaaaaaaagaatattgccagcccactcttctcccccaccagctttcactttattactccacactccttctgccccaaaggcaagtgcttttatgataaacacttctttgcttttttcttttttaatcattttactacctaagcccacatccctaaatactgcagttttgttttggtgggttttttgtttgtttgttttgtggtttgttttttttttttttttgagatggagtctcactctgttgcccaggctggagtgcagtggcgtgatctcagctcactgcaaactccacctcccaggttcaagtgattctcatgcctcagcctcccaagtagctgggattacaggcatgtgccaccacgcccagctaatttttgtatttttagtacagatgcgttttactatgttggccaggctggtcttgaactccccacctcaagtgatccacccacctcagcctcccaaagtgctgagattacaggtgtgagccactgtgcctcgtcttgttttgctattgttttgtacgttatatataaacaaaatcatacctttttgcctaagtttctttccctcaatattgtttaacagtttcatccatcgttgcatgtggctgtaatctattcttttgtataattcgtatactattcctttgcaagaacaccctacagagtatttctctgttctcttggcaatggacatttgagttgcttctattttggggcaactaggaaaattgctgctccgaacattctggtatatgtttattgatgccgatgggcacacatctctgttgagtaatacccaggagcaaaattgcatggtcatgcagctctagataatctcaaaccacttgccagagtggtcgttctagtgtgtactcccatcagcagtgtgtgtgggtttcagttgttctacatcctcaccaacatctggtgctattagtccttttacttccatgcatcctgagaagtgtgtcatgagatcactagtgtttttcatttgcatttccctgtttattaatgagattgaacaccttttcaggtgtttgttagctattcggatatcctctgttgtgaaatacttttcaagtccaaggcctatttttctgtttgttatctttttcttgtcaattcctaacagtagcttatatcttctgaaaatgagtctgtgtcagtgtgggtcctccaggaagcagatgttgggacaggatgagatagacatgcaagagatttactgggagaaacagctgtgagggataaagaagaaggagcagggctgggcacagtggctcatgcctgtaatcccagcactttgggaggccgaggcaggtggatcacctgaggtcaggagttcgagaccagcctggccaacatggcgaaaccccgtctctactaaagatacaaaaaatagctgggcgtggtggtgggcgcctgtaatcccagctactcaagaggctgagccaggagaatcgcttgaacccaggaggcagaggttgcagtgagctgagatcgcaccattgcactccagcctgggcaacagagtgagactccatatcaaaaaaaaaaaaaaaaaaagaagaagaagaaggagcagaaggaggcagggagtcttctatgagatgtagacctgcccctgggaaggagagaacggaggaaggatggcttagtaggtaggaagagtcttagactaagcacaattcaaagaaagtttatttttcaggcagtggggtgctcaaaagccaaggttgcctgatagaggaatcgaatcctgcatcctgcagcatggatgtgcatgagtgccctcatggtatgggggatggggtgctgtccccactagggcgctgcactagggtcctgttgggctgtctgtgacctgcattctgggcactaggttctcttgaaggaggccccagccctttgtcagttacatatgttgcaaacatcatcttccaccctgtggagtaacttttccctctctcttcttaaaaatacctgaaggaaggaatattttggttttcttattttttattttatttttatttttttgagactgagtcttgctctgtcgcccaggttggagtgcagtggcgcgatattgactcactgcaacctccacctcccgggttcaagcaattctcctgcctcagcctcctgagtagctgggattataggcgcccaccaccacacccagctaattttcgtatttttaatagagacggggtttcaccatgttggtcaggctggtcttgaacccctgacctcatgatccacccgccttggcctcccaaagtgctggggttacaggcatgagccaccacgcctggccttttatgttttattttttatagatagggtccaactctgtcacccaggctggagtgcaatagtgccatcctagcttacagcagcttcgaactcctgggctgaagcaatcctcctgcctcaatcttccaagtagctgggacgacaggcacattccaacatgtccagttaggttgttttgttttgttttttgagacagagtcttgatctgtgacccaggctggggtacagtggcccaatcttgcttcactgcaacctccacctcctaggttcaacgattctcatgcctcagcctcccaagtagctgggattacaggcacgtgccactacgcccagctaatttttatattatgagtaaagatgaagtttcactatgttggccaagctggtctgaacctggcctcaagtgatccaccaacctcagcctcccaaagtgctgagattacaggtgtgagccaccatgcccagccccagctagttttttattatgttttgtagagatggggtcttgctgtattgcccaggctggtcttgaattcctgggctcaagtgatcctcttgcctcggcttcccaaaccactgggtttacaggcatgaaccactatacccagccttttcgtctcttgatggtgtattgtgatgaacagacactcttaattttaatatatttcaatctattgatcttttctttaataatgattgcttcctgtgtcctatttaggaaattttttcttaattgaaatcatcaagattatattaccttttaaagtttaattgattgattattatcattactctgccttttacatttagatctacctgtaattgattttttgtgtatggtgaaaggtatgggtccaaaatttttctgtataaagatctaattgtctcagtaccatttactaaaaaggcaaccttagccaggcacagtggctcacgcctgtaatcccaacactttgggaggctgaggtgggctgatcacctaaagtcaggagttcaagaccagcctggccaacatggtaaaaccccatctctactagaaaaatacaaaaattagctgggcgtcgtggtgggtgcctgtaatcccagctactcgggaggcggaggcaggagaatcacttgaacctgggaagtgggggttgcagtgagccaagatcatgccactgtactccagcctgggcaacagagtgagacgctgtctcaaaaaaaaaaggcaacattttccactgctctgtggcaccatctttttgtagagtacacatttatacatgagtttgtttctgagctgtttttcctctccattgatctagtccattcatgctcttgggagtgaaaatatcctcaatattacaatggtttatggccctccaaagggccatacacagtacatctgtggtattacattttcataggccaagatcactccactgcactccagcctgggcaacaaagtgagaccccatcaccaaataaaaaaaaattagccatgggtggcggtgcatgtctgtagtcctagtgatttgagaggctgactgcttgagcctagaacgttaacgctgcagtgagctatgatcatgctactgcactccagcccaggtggcaggacaagaccctgtctcaaaaaaaatgaataaataaaggccaggcaccgtggctcacacctgtaatcccagcactttgggaggccaaggcgggtggatcacttgaggtcaggagttcaagaccagcctggctaacatggtgaaactctgtctctactaaaaatacaaaaattagccaggcatggtggtgtatgcctgtaatcccagttattcgagaagctgaagcgggagaatctcttgaaactgggaggcggaggttgcagtgagccaagatagcaccactgcactccagcctgggcgacagagcaaggctctgctcaaataaacaaataaataaataaggtagatggttaaacaaatattggtccttggctgggcgtggtggctcacgcctgtaatcccaacattttgggaagccaaggtgggcagatcatctgaggtcgggagttcaaggccagcctggccaacatggtgaagctctgtctctactaaaaatacaaaaattagctgggcatggtggcatgcgcctggagtcccagctactcaggagactgaggcaggagaattgcttgaacctgggaggcagaggttgcagtgagccaagatggtgccactgtactccagcctgggtaacagagagagactacatttcaaaaaaaaaaaaaacacaaatgttggtccatgcatactatggaatactactcagcaataaaaactactagtggtatacagaaaacaaactactgatttatacaacaacttgaatggatctcagaggaattatgctgagtgaaaaaagacaatctcaaaaggttacatatatgaatccatttatataatattctggaactagaatagattggtggttagcaggggcggaggaccgggggtggtgagagttataaaggaatagcatgaaagagagctttgtgagaatagaactgttcagtgctttgactgtggtggtgattgaaggaatctacgcatgtgatcaaattgtgtataattacaaacatacacacaaataagtgcttgggacatttattcatttcatgacaagaaacttttttttcctttttttttaagacagaattttactcttgttacccaggctggagtgcagtggcacaatcttagttcactgcaacctccgcctcccgggttcaagtgattctcctgcctcagcctcctgagtagctgggattacaggcgcgtgccaccatacccagctaattttttgtgtttttagtagagacggggtttcaccatgttggctgggatggtctcaaattcctgacctcaggtgatccacccgcctcggcttcccacagtgcagggattgcaggcgtgagccactgtgcctggctgataatttttttttttttttgacatgccgtttcgctgttgtcacccaggctggagtgcaatagtgcgatctcagctcactgcaacctctgcctcctgggttcaggtgattctcctgcttcagcctcccaagtagctgggactacaggcatgcaccaccacacccagctaattttgtatttttagtagaaatggggtttcgccatgttggccaggctggtctcgaactcctgacctcaggttatccacccacctcggcttcccaaagtgcagggattacaggcatgagccaccaagcctggcctcatgacaggaaatctgattaaagtctgtggatagcaccaatgtcaatttcctggtattgataatgtgctatagttatacaagatattaccattgggggaaacagggtgaagggtaaactggacctctccctctctctctctctctctctctctctctctctctatatatatatatatatatatgtgtgtgtgtatatatgtgtgtgtatatatatatatatatatacacatatctatatatacatatataatgacttcccatatatctataattgtttcaaaataaaaggtttaaacatgttttatggaagaagggggaattatggaaaaaaatatctacagaggctcttgtggggacaggaatgaaaaccaggttgagaaacaatagtctagcttgtcttaattactacagttttgtaataaatcttgatgtctggtagaagaaatcctgtgggaaagtaattttatctttagattcctgcctcagggaaatcaaaggcaaacttttattgtatgtaaattatagctttctcagaaagtcctttaggccaggtgtggtggttcatgcttacaatcccagcactttgggaggccaaggtgggcagatcactggaggccaggagttcaagaccagcctggtcaacatggtgaaaccctgtctctactaaaaatacaaaaattagccaggcgtggtggcattggcctgtaatctcagctactcgggagtctgaggcacgagaatcgtttgaacctgggaggcaaaggttgcagtgagctaagactgcaccactgcactccagcctgggtgacagagtgagactccatctcaaacaaaacaaaacaaaacaaaacaaagtcttcccttatgcacctccaatccagcaaatcctgatcacagtctactcagctaaatgagctccatctcacacagcatccaacactctgctgtttgagggggagaaaaagagagtaaaaagaggagcaagggccgggtgcagtggctcatgcctataatcccagcactttcggaggccgaagcaggcgatcacctgaggtcaggagtacaagaccagcctggtcaatatggcaaaacaccttctctactaaaaatacaaaactagccgggcgtggtggcaggtgcctgtaattccagctacttgggaggctgaggcaggagaatcgcttgaacctgggagacggaggttgcaatgagccaagattgcgccattgcactccagcctgggcgacaagagtgaaactccatctcaaaaaaaaaaagaaacaaaaaaatgtgccctcaatgaccatttgtgaatgaatgcatgcatgcctattgaagaactaaaatgttacttgtaaagttcattttgaaagaaaccagattaagttactcaatggaatatcggcttatcttttccttccaggaaataaatgtgacctctgggaaaagcggcacgtcctgttcgaggatgcctgcacactggctgagaagtacggcctcctggccgttttggagacatctgccaaggagtcaaagaacatagaagaagtcttcgtgctcatggccaaggagctgatcgcgcgcaacagcctgcacctatatggggagagtgccctgaacggcctccccctggactccagccccgttcttatggcccagggtccaagtgaaaagacccactgcacttgctaagatgtttgcaaagccagttgcacccaccaaagaggccgcctctgaaaccaaaggtagccaggataccgtagtgttgccccagtggcgctttagaccccag

SEQ ID NO: 142 - DNA, 26530 bp, Homo sapiens
gaacagccaactttttttttaattgttttatttgggaaaagtgcttcttacaaaagggcagctgcaaaatacagagacctctgcaacaattatttgttttttcttaaagtgaaagaatgggtgggatccaaggaatcaaagcagtagatggacaaaccaggagcatccccgagttattttcaggaaacagagcaacaaaacacaaaggtacaatttccaatcaaggaattcttccaacaacttaactttagctaatctcagggattcccaagccctccctttcggtggaaaagtatgacttatcactgcaaacccattactccactacaataaacaccttagaacagagttttgaatcacgtctgtctacctgaaagctcaggggtggaatgaggcaaatacccacaaaaacaaacacaaaaacccgacaacaaaatgcctcaagtgaggacaaaggtttctcagaaagtgcctgtactggaaaggctagatcgtaaaacattaaatacaactgtgtatccaagacccagtttgtgttattatatgggataaccaggtagttttaacctctatggctaaccccatttctctatttatatagacagagctagcactgctatattgacaactaccaatatactgctttgccctttaagatctatctgccacacaaggcttaaaccactaaaccaggtttttctactaaggctaagaatactgcatctatgcagggatgagaagcttatcacacacccacacactcacaccatgtcagcccttgggagccaacttccaactctgcattgatgttatgcctctctatcttttatacgtattctttctcaattttcctatcatgcaaaacagtaaaaaatctcaacacattcacacctgattctggttacccagtagtattacttgtgtgcaattaaacaagagaccaaaaccacagaacaagtgcacgtggtagggattacagggtagggaacagatataaaaacacagatgtgcagatttcaccagaaacctcaaggatccacatcccatgtctggggcagagggctattggccagcttaggtcccttcacccatcactcctattcttggaccccaaagcagggccactgcttttacttttgaacctggggtcctcaaaatgagtgtgtgaaaagtccataaatgcaatctggttgaaaacagatgacgcaacacacctacactaactgtctgacagttaaattcgtgttacaaaaaactaactttaagatttatttttgtaacttttttcaacagggaaaacaacacactcctcagggaaaggtgaggggttgagaagacaggccctgggtaaaaattcttaggacagcacctggagttgagaggcctgcctaggagagaacacaggcactgccacaccaccacaggggacagctgctgtctgaggtcagcagaccagttcacacgccacgcaaggttgctatagatccaagtcataaaaatcttccagctcatcatgaaacaagtcccactcatcttcagagtctgttagttcgtcgtccccacctgcagccaaaagcataagcaacatctcgcccagctcaaaggtgacaacctcttcttcatcgttgtcaaaggggttgctgttctctctttcctcaatgagttcccagaagtggttccttcgttgggcctgtaaaaaacaaggccatgatagggatggcactgtcgagcagtatcttctatcctgttgtttataaggcaaaacgtccagcacaccagagggcatgacgaaccagacttcttagttagggtttccatttaccacttcctcccctctggttacttcatggaaatcgtttaggctagagctttaacacacattttttcttcctttcctatccctcccagttttctgaggtttgtttcctcctttaatactctacactttcgctcccagacctgagcgttaaccttctccttcccctaccccaatatgtgcaggactcaactgataccttggaatttcccctcctttaaaaaaacagtgagagttacccggtatctgcttgatgttcccactttctgtctctgtggctcctctctacggccatcagggtacgcatgcttgtaaaaacagttccctccaaatgggcagctcccacgtccttcatcaaaatacctgcacgccttgttgctggaaaggaaaatatcgcaacccttattcacagtggatttcaggtctgtatttgactatcatccggggtttctttaaacaggtagggatagaaccagtatgtcagcttacagccctccccaagatgtgttcttataaacatgtgtgtgccaatgcaagaaacactaactagaaaccggtaactctgttcaagtctatgctggttaatagctctagtacaagcagatgccatagagagaaaatcttctagaaagccaacacatgagaacataggacagctatgacacggattcagaataaggtagaaccccactcatggggccttacttgtcaacagtagagacctctttataacacagtcccttggcatggaccccaaggactgtgttatagcaagatatatactggatgttatcagggtgacaaaataaactgtcctgggaagtcaaagaagggtaggaaggaggtaggagtgtataatgcagcaccattcttttcaaagtgaacccaagctctgttgggctcttcgcttgagaaaaggctgcagtgctcatacctcattgcctccttgtatttcagaatgagtttctgcttctcttctttctcctccacccagtactcacttggaatgacaaagttagatgtgatccggcattctgggcaggacctgggaaacaatgaacaggctgcaatgcaaattccccttttacaggcccactcttcaaggacacaccctggtgtgtcgcctccagacttaaagacttaactgaaaggcacgtgggcatttcctgaaagggttccacatactgtcacacaactgaccatttctttcaagcaaggcaacctcctttataaatccaactcaagggctagccagttctttttttttttttttgaaaaatataacttaggtaaaaaacaaaaacaaaagaagacatttcacacagactcctttttctttcgtttaaataaatttatttcttgtagctttgctctgtttagattatgtggtttttgttcagttatgagaacaatctttaaaggatggtggattgttggctagcttaatgaatggaataggaaagtggaaatgtaaaacgtcaggaaacatacattcagagctagatcagtttgttcactgagcctaaactggctaataatccattaaacacaatctcctcagaaaaagcacgaagattctaactgatacacagggtttcctcattcaaataaaagtagatagaccaactaacctagaagctagctgaaatacaaagaagaaatccccattagaatatcccagtttcaagataaaatgcatgcatttaaatgcggtccatctggttgaaagttggcacaagttactaaattcttccccaaaagagaaagcacaaatgaagactggggaggagtctcactttatgatcttgctctcaaattgcttagcactcctccacttgcgaatgcacttgagacagtaggtgtggttgcagttggagaggatcccgaagcggcgctcactggggttggctttctcatagaccacctccatgcagatcccacacaccatgtccttgctgcgctgcacggcaaatgagagctccatgtccttctcatgggcctcaatgcacgactagagaaggtggagagagaacaagtggaatccagtcattgaaccctgaaaaacttgagcaacagttaatgattcacagtcaaagaatcaaatagtcaactgaaaaaacaatgttcccaagctgacacgaaaattagctttgctgacaagtaaacacaggtgtggtgttttttttttgtttgtttgtttttgcggtggtacttaacaatactagaaaatcaaactatgaggactcaacttcgggaactgaaaaattacccaattttctctaccccaaacctggagctcaactacattaaagacggttttccatactgtttgttatttctggtttctacatgaggttaagaccctagttaaaacctgtcggaaaataagggtgacaggcacgtaaactctcttatgcctttaaagaaaaacaacttcatcgagatttttcaactactcagcttgatagactgatgcacacttaggttaggttagattagcccactttggggctattataaataatgctgccaagaacattcatgtaccaatttttgtgtggacatcatattttaacttataaaaaacatgattataggaaacataaaaatgcagaaaactcccagcactttggaaggccaaggttgggtggatcacatgaggcctggagttcgagaccagcctggtcaacatggcgaaaccccatctctactaaaaatacaaaactgaggcaggcgtggtggtgcatgcctgtagtcccagctattcgggaggcagaggctgcagtgagccgagactgcactgctacactccagcctgggggacaaagcaagactctgtctcaaaaaaaaataaaaataaaaaaaataacactgcagaagagcaatgtcatccataatctcacatcatcactaaacatgtcttttcctaaacctttaaaagaaaaaacatatatacatatattcagaggtaggttctactacctcaatatatagatataacgtatagagatttatcctgcctaaattcacaaaagtacgctgaagatagggatcaaattatgtctaccttataacatgcctcacaccctaaaaccacatttaaaaagatggaaatttaaaagagatggaaatgattagaagcaaactttgctccaataaagttaaagtttctaacacaatgtcttctgaacctaccctggctcccatacactgctgctggaaatgtaaaatcctgcagccactgtggaaaagtatggcagttcatcaaaacgtaaagcagagttcctatgtaacccagcaattccactcctaggtaacggaaaacatatcttcacagaaaaacctatatacaaatgttcctagcagccttattcataatagccaaaaactggaaatgatctaagtgtccatcaactcatgaatggaaaaacaaatgtggtctagccatacaaagacaataattcagccatcaaaactaagaacggctacacgcaaccacacaaagaaccttgaaaacactatgttaagtgaaagaagtgaagtcaatcacaaaggaccacattacaggattccatttacatgaaatgtccacaataggccaatccagagacaaagcagattcgttattgccaggagctggaggaaggctggaataaagagtgactgctaatgggtgtaggatgatcaaattatcctaaaattagtaaaatggtaatggttgcacatctctgtaaatatactaaaaaccaatgaaatgtgcattttcaaaagattaaacatattcaatgtgaatctcagaaacattattttttaaaagaggaaaaaaatgttagaagtctatagtctgagtttctggaagtaggacttctttttttcttttgcctcaacctcctgggcttgagcgatcctcttgcctcagcctaacaagtagctgggactatagacacatgcctccatgcccagttaattttgttcactggaaatatgacttcttgataaagcatccaagaagcccaagaaaggaaaacttccctactcactgataaccattcaattcatcaaatgtttctctgaaataaacccacaatgctgtgaaagggcaaataatgattctcacatctaataacacacacatctccctaaagacttactttgatatgctgcgatctctgggcagcatccattggatgcaggacctgcagcccacacatgtcacaagaatctccgtggagatacacacagttctccccgtatcggcactctcccactgcagcataggggcacagctgcttctttgtctccacggcggtttgctctttctctgattcttccttggtcactgagccctgcaggggtgcttcagtgcaggaaggcgcagctgaaaatgtgtaagagggtggtaaaggtccaaatagataaggcatgaactataagagaactgagaatctaaccgcaaaaaatgaaaataaaactgcaatgaaataccaaaacagtctactgaactaacttcttcacttgaaagaaaggaattttttctaccgctgttatttccaagattagacttgtaaaaaaaaaaaattgcttctttatctatgtcttgggtaactgaaatttaatttcaaaaagtactcgaaaggattcagtttttcaaaacattctgaattcatttcactgggattaaaaatttccttcactctatctgtaaatcttaggtaatccaaattaaagtactgtactaagattaaactaaaaaaggaatagaagcagaaaggggaaagttgtcaaaactaagcaaatggatgaactgctatccagccctctaactcttattttcttcttcagaatacttactacggccacagtagggttgcccaggaacaaactcaatagcattcacccagtcctctgaacctgctcctacagttgcaaagtttgaatttcttgactcagcttcgcctgtattcatttcaacaagtggtccaactatcgatgagagacttgaggaagcagcaagggatgactttgtagttagctctgtagcagttgcttcttcctgtttcaatggtttgctatgttcatatctaagaaaaaattcaaaagtaagcagtcggccagtcgtggtggctcaagcctgtaatcccaacagtttgggaagctgaggtgggtggatcaccagagaggttgggagttcgagaccagcctggccaatgtggtgaaaacccgtcactaccaaaaacgcaaaaattagctgggcatggtggcgcacctgtaatcccaactactcgggaggctgaggtaggagaatcacttgaacccaggagacagaggttgtggtgagccgagatcatgccactgtactccagcctgggcgacagagtgagactccgtctcaaaaaaaaaaaaaaaaaaaaagtaagcactcactgcctaacttcatatatacctttttcttttctttttttttttttttttgagatggagtcttgctctgtcatccaggctggagtgcagtggcgtgatctcagctcactgcaaactctgcctcctgggttcatgggattctcctgcctcagcctcccaagtagctgggattacaggcgccagccaccaaggctggctaagttttgtatctttagtggagatgccgtttggccaggctgatctcgaactcctgacctcagatgatccacccacctcagcctcccaaagtgctggggttacaggtgtgagccaccacgtacggccatatattcctaatacattccttggattctctttgagcatcaatgtgcctgtatttgtgagtgcagagagaagcctatgattctgcatatttagttataccatgtgtgatgccaagactgctggtccagagaccatacttttgagtaggaaggcaatagactgggggtcaccaaagtttaaagcatcaaatacacaaatattttaggctttgtaggtcatacaatcaacatcacaactacaagtattcaactctgaaactgcagtgcaaaagcaggtgtaggcactatttaaaggaatgtgtaactgttccgatcaaacttgatttatgaaaacggcctttggccagatttggcctgtaggcccatacccctggctatataccacttattacttcaaattccactctaattaggagtttcagatagttgacagtctatagttcccatggtaactctgccagaaaccctgcaggcaaaactgactgatttcaaagcaaggctgacacaaggtcaataagcagacatgtggaacattttaccaacacatcaaataaaatgctgtcactattaaaaggtagagacaatatttatacaatacacaatatgtacattctttttctaagaaaatccatccattcaccatttccccttccaaattttgcccctatgcattctctccttttcatctgtaaacattaaaccaccaccatctccaaatacgtggggaaaatacatctatttccttcaagaaccttctttctggcctggtgcggtggctcacacctgtcatcccaacactttggaagtccaaggaggccagatcacttaaggccaggagtgtaagaccagcctggcgaaacctggtctctactaaaaataaaaaattatccgggcatggtggcgcacacctgtaataccagctactcaggagaggctgaggcataacagttgtttaaacatgggaggtggagggtgcagtgagccaagatcaggccactgcattccagcctgggcaacagagtgagactctgtttcaaaaaataataaaaaaaaagcaaagcatagcaagcatctttctgcctgagaaaattctcacagttcctgctggacgtggtggctcaggcctgtaatcccagcactttgggagggtgaggcgggtggatcacctgaggttgggagttcgagaccagcctgaccaccatggagaaaccccgtctctactaaaaatacaaaattagccaggcatggtggcgcatgcttgtaatcccagctacttgggaggcagaggcaggagaatcacttgaacctgggaggcggaggttgcagtgagcctagatggtgccattgcactccagcctgggcaacaagagcaaaactccatctcgaaagaaaagaaaagacaattatcacaattcttttagcattttacactaagaaattgactgattttcagagactcactctatctcctaggctggagtgcagtagcgtgaccttagctcactgcagcctcgacctcctgggctcaagcaatccgtctgccttagcctcctgagtagctgggacgacaggtgtgtgccacaatgctggtctaactttttttattttttgtagagacaaggtttccctatgttgtccaggctggtctccaactcctgggctcaagcaagcctcctgccttagcctcccaaagtgataggcatgagccaccgtgctcggcacaccgagttttattcagatgctatgtattaattatgcatatagtaaatttaactgtgctacataatttatagtttgttatcaagtggttcttataatgaaacattactaactttgggtcatctgtgttataggtgcctatgtttatacgcaaaaataaagtaaaatctaactaaaggctctactccagcttatggcaaacattttactgagctggtctttaatcattgttattattacctcaaacattcatattctagcactctgggaggctgaggtgtgggtggattgcctgagctcaggggttagagacaagcctgggcaacatggcaaaactccgtctctactaaaaataaaaaaattaggcagggcgcagtggctcacgcctgtaatcccagcattttgggaggctgaggtgggtggatcacgaggtcaggagatcgagaccatcctggctaacacggtgaaaccccgtctctactaaaaaatacaaaaaaattagccgggtgtggtggtgtgcgtctgtaatcccacctacttgggaggctgaggcacaagaatcacttgaacccaggaagcggatgttgcggtgagccaagaacgcaccactgcactccactctgggtgacagagctagactccaactcagaaccaataaagactatgcgcggtggctcatgcctgtaatcccagcactctgggaggccaaggcaggtggatcacttgaggtcaggagttcgagaccagcctggccaacatggtgaaaccaccatctccaaagacattcatattcctcctcttaagccttaggtaaactacctcgccttgcagcaaaagtaagctgagtatcctgctatcatccacaaaaacccaatgcattgttctatagagtggaatcctataagctgaaggataagggaagaaactatcatgaatatgctctttcactttcactcatgaactgtggggaagtattctatcattttagagatgacctcactgtcctactaagtgatggggttctaggtctaatgggactctaaagctgctctatacagtacagccaaccactgcccacatctaactcttcagacttacatacaattttaaactcagttcttcagtccttcctctagctatacctgcaagtgttcaaaagctacatggagctagaagctaccgttagatagcaacatgaagaacatttccagtactgcatgaagttctactggatggcagtattctgaaatgttagagcagcaagtatccttagaaatccagcccaggctggacgcggtggctcacgcctgtaatcccagcactttgggaggccaaggtgggcggatcacaaggtcaggagatggagaccatcctggctaacacggtgaaacctcgtctctactaaaaatacaaaaaattagccgggcgtggtggcaggcgcctgtagtcccagctactcgggaggctgagggaggagaatggcgtgaacctgggaggcggagcttccagtgagagagctgagatcgcgccactgcactccagcctgggcgacagagcaagactccatctcaaaaaaaaaataaaaagaaatccagcccaaagcctcacttttcattttacttttgttttgttttttgagacagtctcactctgtcacctggctagagtgcagtggtgcaatctcagctcaccggcttcaagtgattctcctgcctcagcctcccaagtagctgggattgcagatgcggcaccaccaagcccagctaatttttgtatttttagtagagacggggtttcaccatgttggccaggctagtctttgaactcctaacctcaagcaattcactggcctcagcctcccaaagtgctgggattataggcgtgagccaccgcgcccaggcccaaagccttacttttcagattaagtaactcccttggagccaagcttcatggctccagcctataattccagctagttgggaggctgaggtgggaggattacttgagcccaggaatttgaggctatagtgagtcacgatcacaccactgcactccagcctggatgacagagcaagactatcctgtcccttaaaaaacaaaataagccaggcacggtggctcacacctgtaatcccagcactttgggaggccgaggtgggcgatcacctgaggtcaggagttccagaccagcctgatcaacatggagaaaccccgtgtctactaaaaacgcaaaagaattagctgggcatggtggtgcatgcctgtaatctcagctactcgggagactgaggcagaagaatcgcttgaacctgggaggcggaggttgcagtgagccaagatcgtgccattgcactccagcctgggcaacaagagtgaaactcagtctcaaaaaaacaaacaaacaaaacaaaactccctggtttaaaagataatttccaaaaaaaaaaaaattagttatttttacaagctttatattttttgttttctttgagacagggtctcactctgtctcccagactggagagcagtggcacaatcacaattcactgcgcccttaacctccctgggctcaggtgatcctcccacctcagtctccccagtagctgggactacaggtacacaccaccacacccagctaatttttattttgtaggtacgtagttttgccatgttgcctaagttggtctcctgggctcaagccatcttccccgcccagcctagtacaaatgtctaaggaagtttaatcaatttttctgtctctgtaagagaaaataaccctttccctggttggtttacaactcccaccccattgcttctgtggcctttagtattttaaagtattggattcttcagttggtccaaaaaccaaaactccaaacaagaagtcaaccaaaccaggccaggcacggtagttcacacctgtaatccccagcactttgggaggccgaggcaggtggattacttgagggcaggagttcaagaccagcctggctgacatggtgaaaccctgtctctactaaaaataacaaaatttagccaggcatggtggcacatgcctgcaatcccacctactcgggaggctgaggtgggaggtggaggttgtgacattgcaccactgcactctagtctgggcgacagagcacgactccatctaaaaaaaaagaaagaagtcaaccaagccaatattgcccctttccccagagggtgtccagaaacaaagactgggagttctaatggcattctgggaaaatactagactagatatctgcaatatgcaaaacagtcccgagcaacaaagaactggcctcactaaacaaaagcaccaccattacgaaacactgatgcagaaaatcctctcaactgttggggctatgatgctatccttcattatcaatgatctactccctctgtgaagagggaaatccctgggctttgagcaagttacataaagagatcccaacactaagagtaagaggtaggtggccgggtgtggtggctcacgcctgtaatcccagccctttgggaggccgaggtgggcggatcaggaggtcagaagatcgagaccatcctggccaacatggtgaaaccctgtctttactaaaatacaaaaaaattagctgggcatggtggtgcgcgcctgtagtcccagctactcaggaggctgaggcaccggaatcgcttgaacccaggaggcggacattgcattgagccgagatcacgccactgcactccagcctggtgacagagcgagactccatctcaaaaaaaacaaaaaaagataaggttgaagttcctagatatcattctaacaggaaaacaagcagtcatagagcaagcctctctttaagattctttctttagctagtccacaatcaaccttttaataatcacctatatcagcctgtactcaacaattatcaccaaactttcaagtagactactatagtttctctacttcctttcactttatgctaagagatctaaacccagctcaattctggctcatcctctaaagagttctagaaaagaggcagctacatccttattaaaaggaaaattaagaggccaggcccagtaggctcacacctatgatcccagcatattgggaggcaaaggtgggagcatcagttgaggctgggagtttgagaccaacctcggtgagatagggagaccccgtctctacaaacagaataaaaaaacttaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacgtgggaagcggagcttgcagtaagccgagattgcgccactgcagtccgccgtccggcctgggcgacagagcgagactccgtctcaaaaaaaaaaaaaaaaaaaaaaagaataaaaaaacttagctggaggtggtggttgcagtgagtcgtgttcacaccactgcactctaacctgggcaagagggcaagaccagatctcaaaacaaagaaagaaacaaacaacaaaccaattaaggttcctttcaactttttctttttttttttttttgagacagagtttcgctcttgttgcccaggctggactgcaatggtacgatcttggctcaccacaacatccacctcccgggttcaagtgattctcctgcctcagcttccagagtagctaggattacaggcatgcgccaccatgcttgggtaattttgtatttttggtagagacggggttttccacaggtcaggctgatatcaaattcccgacctcaggtgatcctcctgtctcagcctcccaaagtgctgggattacaggcatgagccaccaagcccagccgccccctcccccactttcttttaagacgaagtctcactctttgcccaggctggagtacagtggcacaatcaaggttcactgcaaactctaccttcccaggttcaagtgattctcccacctcagcctcccaagtagctgggattactgacacgtgccaccatgcccagctaatttttgtattttcagtagagacgaggtttaaccatgttggccaggctggtcttgaaatcctgacctcaagtgatccgcccacctcagcctcccaaaagcgcggggatgacaggtatgagccactgtgcccagtccctttcaacttggagccatctgcatctgcctcaacgtcagaggctcaccaaaatagggaacctacctaatttcctctggtctcaaactatttggggcgggcaaagttgcctgaaaaataagatggttaatacacagagcccaggcagggggctgtggctcacgcctgtaatcccagcactctgggaggctgaggcgggcggatcacctgaagccaggagttcaagaccagcctgaccaacacggagaaaccccgcctctactaaaaatacaaaattagctgggcatggtggcacatgcctgtaatcccagctacttgggaggctgaggcaggacaatcacttgaacccgggaggtggaggttgcggtgagccgagatcatgccattgcactccagcctgggcaacaagagcgaaattctgtctcaaaaaaaaaaaaaaaaaaatgcagaggcttagcacagatttcttcaatttaaccttcatttttttcattcactccatctacacagtccattcagatgagcacttcttctgaaataaggaccaactgctaattatctatagctttctgattctatctcacagtctattctcatccctctgcttgggaggttggattcttcactctcatcaatattcaactcctcctgccccagtcacagttggcagtaactctcaaaagactagaacccagttcaaggaacacagctcccttacaattagcctcaatacctgcagagactataccactacaaagattcgtccattcaccattgcagtgtgaagttctcatgactctgccttttatattgggactgcaaaagacatgcctggtggagaggccaggtgcggtggctcacgcctgtaatcccagcactttgggaggccgaggcaggtggatcacctgaggtcaggagtttgagaccagcctggccaacatggtgaaaccctaactctactaaaaatgcaaaaattagctgggtgtggtggcacatgcctgtaatcccagctactccggaggttgaggcaggagaattgcttgaaccagggagtcggaggttgcagtgagttgagatcatgccacagcactccaacctggcgacagactgagactctgtctcacaaaaaaaaaaaaaaaaaaaaaaaagacatgcctggtggagagtttgagaataatgtcattgtgtcattttccccctttttcagcaataatgcaatgacaaattagcaaagggcaaaatgagtagcaactaaacaaagtttctatgagatcaacttctgaacttctacacagtcatttgaaaaagatcttctctttcccctcatccttactggactcttaataaacagatgtgggatgacttaacattaatatcccacaccatcaataatgtcaggttctgaactctatttgaacccagtggctcacactacattttctgataatgacattaaaattgactatgactatggcacagtggctcacgcctgtaatctcagcactttgggaggctgaggctggcggatcacgaggtcaggagatcaagaccaccctggctaacacagtgaaaccccgtctatactaaaaatacaaaaaattagccaggcgtggtggcgggcgcctgtagtcccagctactcaggaggctgaggcaggagaatggcgtgaacccgggaggcggagcttgcagtgagctgagatcccaccaccgcactccagcctgggtgacagcgagactccatctcaaaaaaaaaaaaaaatttactatgacactgtcaaaagtcttaccgagggtagtggtttaaagtacatacaaaactctttgatatgccttccttcaaaaggtagagcccaatcctctccctttacatgtgggctggacttagtaacttagtccagaatcagtggaaataacagtatatgacttctgacactaggtcataaaaggcattgtggcttttccttgcctcctctgttaaattgtttgctctggggaaagctagctgccaagctgcaaggatactaaagtatccctatgaaaaggcccatgtgggccaggcggggtggctcacgcctgtaatcccagcgctttgggaggcaaaggcaggtggactgcctgagctcaggaatttgagaccagcctggccaacatagtgaaaccccgtctctactaaaaatacaaaagttagtggggtgtgggccgggcgcggtggctcatgcctacaatcccagcactttgggaggctggtgtgggctggtcaggagatcaagaccatcctttcaacaaggtgaaaccccatctctactaaaaatacaaaaattagctgagtgtggcggtgcatgcctgtaatcccagctactcgggaggctgaggcaggagaatcacttgaacctgggaggtggaggttgcagtgagctgaggctgtgccactgaactccagcctggcgacagagctaggctctgtctcaaaaaaaaaaaaaaaaaaaaaaaaattagccaggtgtggtggtgcatgcttgtaatcctagctactctggaggccaaggcaggagaatctctcgaacgcgggaggcagaggttgcagtgagctgagatcatgccattgcactccagcctgggtgaccagcaaaactccgtcttgaaaaaaaaaaaaggccaagtggtgagaaaccaaagtctcctgccaacagtcatgagagtaagacctcttaaaaacaatactgggctaggcaccatggctcacggctgtaatctcagcactttgggaagccgaaccgcgtggatcacctgaggtcaggagttcgagaccagcctggccaacatggtgaaactccgtctctactaaaaatacaaaaattagctaggtgtggtggcgggcgcctgtaatcccagctactccggaagatgaggcaggagaatcgcttgaacccaggaggcggaggttgcagtgagccgaaattgcgccactgcactccagcctgggcgacaagagcaagactccatcctaaacaaaacaaacaaaaaaacccaaacaaacaaacaaaaaacaatgctggctgggcactgtgtctcacacctgtaatcccagcactctgggaggccgaggtgggcagatcacttgaggtcaggagttcgagactagcctggccaacatgatgaaaccctgtctctgccaaaaatataaaaaattagccgggcatagtggcacgcagatgtaatcccatctacttgggaaactgaggcaggagaattgcttgaatctgggaggcagaggttgcagtgagccgagatcttgccactgcactccagcctgggcaacagagggacaagactcggtctcacacacacaaaaaatatcctggagtccccatcaagtcttcagatgacttgctaaaattttgactgccatctcataagtgtctctgagatagaaccatccagctaaggcactcacagaatccggaaccccagaaactgagataataaatgttcactgttttaacctactaaatttggggatgggccagtttctggggctcatgcttgtaatcccaacacttttcggaggccaaggcaggaagattgcttgagcccaggaatctgagaccagcctacgcaacatattaagacccccatctctacaaaaaactaaataaatgaggtggtgcatccctgtggtcccagctacttgggaggctgaggtgagaggatcatttcagcctggtaagttgaggctgcagtgagaagtgaccacaccactgcactccagcctgggcaacacagtaagaccctgtctcaaaaaaataaataaaaaataaatttgagggttacttgtttaacatccacagataatacacctagtcatttctgaactaggaggatagaaaagccctacccaatttttttttaaggtggagtctcgctctgttgcccaggctggagcgcagtggcgggctcttggctcagtgcaacatccacctcccgggttcatgcaattctcctgcttcagcctccgaagtagctgggattacagacgcacaccaccatgcccagctaatttttctatattttgtagacatgaggtctcactaggttacccaggctggtctcaaacttccaagatcaagcaatcctcctacctaagcatcccaaagtgctgggattataggcatgagccactgcccagccaagagtcattttcaaagcattatttttaatcagtgacatataaagctatcagaagtatgtcttttacctttttcctccaacccacccctgaacaaatttataaacaaattcttacctgcagcggtctccataaatacagtaccctcgctgaaaatacttgcacactacactatacggactgtcagagaggtcatgcgagtagcgacagttgtctccttccttacaaaccccatgcataaaatacctgtgagacgaaagaccacaaaactggattaaaaccaatccttgaaaatattaaaactaattagtattcatgactaatatattcaaccagtaaatacacaaacatacgaaataaacacaaagaaagggccaggcatggtggctcatgcctgtaatcccagtacctttgggaggctgaggtgagtggctcacctgaggtcaggggtctaagaccagcggttcgagaccagcctgggcaacatggtgaaaccccgtctctactaaaaatacaaaaattggctggtgtggtggcacacatgttaatcccagctactcaggaggctgaggcaggagaactgcttacacgtgggaggctgaggtttcaatgagccgagatcgcgccattgcactccagcctgggagacagagcaagactccatttcaaaaaaaaaaaataaaaagaaggtgataagaaaacaggagtaaagcaagtgtattagtccgtttttgcattgtgtttttgctttgtagctgggactacaggcgccgccaccacgcccggctaatttcttgtatttttagtagagacagggtttcaccatgttagccaggatggtctcgatctcctgaccttgtgatctgcccacctcggcctcccaaagtgctgagattacaagcgtgagccactgcgcctggcccttgtttttgcattgttacaacgaactattttgacattccagcctgggtgatggagcacgactatgactctgtctcaaaaaaatgtaataataatacgccttagattatgaaaactgtttaacttacataacaaaaagaaaaaaaaagggccaggcgtggtggcccacacctgtaatcccagcactttgggaggccaaggcggatggatcacgaggtcaggagatcaagaccatcctggctaatatggtgaaaccccatctctactaaaagtacaaaaaattagccgggcatggtggcaggcacctgtaatcccaactactcgggaggctgaggcagggattgcagtgagccgagatcgtgccattgagccactgcgctccagcctggacaacagagagactccatctcaaaaagaaaaagaaaaagaaaaagaaaaaaagatatagtctacgtcaaagaatttctcctccaaacaaaaaccaatgaatataagtatatgtcttgtttttaaatgataccaccaaaaaaaaaaaaaaaaacatcatccagattcaccccaagttgagtttgccttcggtgaaaacctgggccatatattatttctgaagttccttccactgtgcagactctgtctccatgagacactgtgcagtaaaagacaaaatttactagaatccccctactgctgtgcctcttagaaacctaatagtggcccccaacatagagaacaagaaactgccaagttaccctgtaagggtacaagagaaccaaacagcaccctcagagtatctctaggcatcttaacaacctctttaggaatttctacaaattatagaatagataaggcatttaatcaattcatctgcagtgacacttcttactttgatatttaacttttaatgagtgagtataccatttatcaaactagattataaattcctgatgggtaaagactggtttattcccctttttatctccaactatctgtgcacataatatatacttgttagaaaaaggtagaaagccgggttcggtggctcatgcctgtaatcccagcactttgggaggccaaggcgggtggattacctgaggttgggagtttgagaccagcctgaccaacatggtgaaagcggtacctactaaaaatacaaaaattagccgagtgtgatggtacaagcctgtaatcccagctactctggaggctgagagaggaaaatcgctggaacccaggagatggcgattgcaccgagccaagattgtatcactgcactctagcctgggcaacaacagcgaaactccgtctcaaaaaaaaaaaaaaaagaaagaaagaaagaaagaaagaaagaaagaaagaaagaaagaaagaaagaaagaaagaataaaagactgtagggtgggcccggtggctcacacctacaatcccagcactttgggaggcagaggcaggtggatcacctgaggtcaggtgttcaaaaccagcatggccaacatggtgaaacccactatctaccaaaaatacaaaaattaggccaggtgcggtggctcacacctgtaatcccagcactttgggaggctgaggcaggtggatcatgaggtcaggagctcaagaccatcctggctaacacagtgaaaccctgtttctactaaaaatacaaaaaaaacaaacaattagccaggcatggtggcacacacctgtagtcccagctacttgggaggctgaggcagaattgcttgaactcgcagtgggttggggggggcccagaggttgcagtgaaccaggatcacgccactgagactccgtctcaaaaaaaaaataaataaataaaaggctgtagaagacagctagatgtgatggtgaatcatggtagcgatagcaaattaatttttctttcccagttgcataatctttttaataccatttaatatttattacttatttcctctcacaaccactatgtagtttccaagtaataaatttcactatggacgtcacagcactcagataaagaatttctgaaggatttccttctttctttttttttttttttgagacgaaatctcactctgtcacccaggctggagtgcagtggtgcaatcttggctcactgcagcctctgcctcttgggatcaagtgattctcccacctcagcctccagagtggctgggattacaggtgcccgccaccacgcccagctaatttttgtatttttagtagagaacgggtttcgtcatgttggccaggctggtctcgaactcctgacctcaagtgatccacctgccttggcctcccaaagtactagaattacaggggtgagacaccacgcccagctgatctttaagttacgttaaccacatttttaaaaacttttgaggccaggtacgggggctcatgcctgtaatcccaggacttcgggaggccaaggtgggtggatcacctgaggtcaggagttcaagaccagcctgggcaacatggtgaaaccccatctctactaaacgtacaaataattagccgagtgtgatggcacgtgcctgtaatcccagcttctcggaaggctgaggcaccagaattccttgaacccaggaggcagaggttgtagtgagccgagatcgtgccactgcactccagcttgggcgacacagactccatctcagaaaacaaacaaacaaacaaacaaaacacaactttcaaggccaagcatggtggctcacacctgtaatcccagcactttaggaggccgaggcgggtgaaacacttgagcttaggagttcaagaccagcctaggcaacagggtgaaaccctgtctctatcaaaaatgcaaaaaaaaattagcctggggtggtggcacgtgcctgtaattccagctactggggaggttcaagcaggaggattgcttgagcctgggaggtggaggctgcaatgagccaagacactgccactgcattccagcctaggggacagagcgagaccctatctcaaaaaatacaaataaatacaaataaaaatcaagaaaagagttttttgaaaaattaaaaattaaacacttgtttttttgtgtattatttcaactaccagaacacttatctgccattatagaagcactctaataaagaggggtctaaattcaaattacaacttctctttaagtattaactgttctaacctcacacactcaaggtaactcaaggtagcagatgcaatgagcatttctgtttcttagtattgctctaataaaagatatgaaaaacagcctggtggtggcagcataacacagtttctgaggaaaggtataaaacacaatgaaaaccccaggagaaacattagaaaaaatgtaaccagtaggaaaatacaggtgattccgagcaattaaaaacattctaatcaaaacttctaagtgaagaaaatagctttagtcaaattcctagatacaggagtgatgtgctatagggagaaatgagcacaaacactaaaacacacctctacctgattctttaggtgatgtttacctagcaaacatattgaaaatgtttatttataatacagtacatacatctgcactctcttgaacacctaatattgtgtctcccattgctggcgtgcaatgtttacttactgaatgattgaataaggtagttccagaaaaaatatacatgtggccgggcgtaatcccacctactcaggaggctgaggcaggagaatcgcttgaacccaggaggcagaggttgcagtgagctgagatctcgccactgcactccagcctgggcgacagagcgacactccatctcaaaaaaaaaaaaaaaaaaggaagatacacatgtgttctgttaagtactttgtctttggtaatttacaagttttgttttttttttttttaatgaaagcagaggaatcttacaaagttcctgttaaagtgggtaattctaggtatatgactttatcaacatcactcaagcatttactcagtatctgctcaggatactcagtaactgagtatcctgttcatgatactggaactgaggaaagaaactgaggaactgaggaaagaaagccctgcagataaaatagggccctactcttctcagagagctcaaagtgaacgataaggatcatagaccgggtgcggtggctcacgcctctaatcccagcactttgggaggctgaggccggcagatcacctgaggtcgggagttcaagaccagcctgaccaacacggagaaagcccgtctctactaaaaatacaaaattagtcaggtgggcatggtggtgcacgcctgtaatcccagctactaaggcatctgtaatgccagagactgaggcaggagaatcaattaaacctgggaggcgggggttgtggtaagtagagatcacaccattgcactccaacctgggaaacaagagggaaactctgtctcaaaaaaaaaaaaaaaaaaatgatagttgacattcctctatctaaaggagaaaatagttttaagtaagagatcatgttggtacctagaacaaccgaaaacaatgtcaaacactaaaaccccagacctatcaaggaatctgcacaacaataaaaaactgtctcaagcaaaagctatacaaaaaacccccaaaaactagtaaatctaagctctttcttttctttctttttcttttttgtttttcttctgacagagtttcactttcgcccaggctggagtgaagtggtgtgatattggctcaccgcaacctctgcctcctgggttcaagcaactccctgcctcagcctccggagtagctgagattacaagcgcctgtcaccacgcccggctaatgttttttgtattttcagtagagacggggtttcaccatcttggccaggctggtcttgagctcctgacctcgtgatccacctgccttggcctcccaaagtgctgggattacaggtgtgagccactgtgcccggcctaatttttgtattcttagtagagacagggtttcaccatgttggccaggctggtctcgaactccttacctcaggcgatccgcccgcctcagcctcccaaaatgctgggattacaggcgtgagccaccacgccgacctagccaccccgacaggccggtttcaatcttttaaaagatgtaactagcacatatagatcaactgtagcattgtaaaagggaaacagatattcaaataatttgctccatgagtagaaactttaaaatcatcattcctggcaatattccacttttacaatccaccgatgaataagacaagtgacctgaaattgcgtttatgctttctacatcccattatgtaaaataattaagcttatccttcacaccttaaatgtatcatatcaaaggctgagagaccttcgaaggtcgccaggataaatgtatcacatcaaagactgggaaggtttcaaatttcacccttaatactacaagttctaattaggaatcatttttacatacttgcatataaattataccacccaggtgaaaaccggcatttcagttgatttattcaactgatagaaaaagaaaagcttacagtcgctactgatcactatttaaaaaccggaaaataaaaaacgtacaattaaatgccctcttctgcgtagagctaggtagttttttacaaccatacacatccatacaaccgccatcccttaatttttctaatattttcgtctcgcatatcaaaccaaaaccaaacctctctctcttccgggagcgaagagccctttcactcccttcggaagatgcgtaaatttcaaaagaggaacatagcgctgggggagggtaataatctgcagctcaaaaaaaccgcgggtggagaagacgaccccggcccccgaacgcctgcttctaagacaaagctcagcaccgccaacctcgacaaacatacaaagaagaaatacaaaagcttcttctcacagttgggcggaggatggggggcggagggacggagggacgtgaaaagacgttacaaacggatggcacggagagaggagagggccgggagccaggcaagctcgctggggccctcggcggggtgtctaggcccggagaggatcgctgggagaccggcctcaagtgaccacctcccgagccccgggagccggaggcagcggcgggggcatccttccagcggcaggggaggagccagcccacctctccccgatgcgctcgcagccagctcaggcagcgctcagggaagtgtaagcggcggtgcagccccgcggctccgcagtaatcgcgcaccgccaggcctccgcggacagcgctgagggctccgcggcccagcgggggttgacgcagtgactgggggaacgcggcggcagcgggggccgcgagggctgcagagatcgagacaacgccggtccccgccctcccgcgcctctagccgcaggccggccgccctcctccctcccgcgccgcaggcttggcccgcggccccctccccgcgcccggcgctccgccgcgcaacgtcctacctgcaggtgacctgtttagtccagccgccgccgctgccgtcgctgccgccgccccctccgcccgcccccagggacggggcggtgactgtggggatcggggtgggggaggctgctgccgccgtcgccgctgccgctcctgctcctgatgttgtggctgttgttccgggagttgcagcctccgccattactgtttatcccacacagcaaaggccccggaacttccgggatcacatagttccggtccggctgcggggagaggacggcgaggccaggcgaggggaggggaaggacactgaggcacccgttcggtccccgcctgctacgcgtcgcgtatctgagcgctctcgccacttcaactgcgggcccagagcatgcgcgcccgcggcccgcccacggcgccgctcattggt

SEQ ID NO: 143 - DNA, 23387 bp, Homo sapiens
tcctttttctttcgtttaaataaatttatttcttgtagctttgctctgtttagattatgtggtttttgttcagttatgagaacaatctttaaaggatggtggattgttggctagcttaatgaatggaataggaaagtggaaatgtaaaacgtcaggaaacatacattcagagctagatcagtttgttcactgagcctaaactggctaataatccattaaacacaatctcctcagaaaaagcacgaagattctaactgatacacagggtttcctcattcaaataaaagtagatagaccaactaacctagaagctagctgaaatacaaagaagaaatccccattagaatatcccagtttcaagataaaatgcatgcatttaaatgcggtccatctggttgaaagttggcacaagttactaaattcttccccaaaagagaaagcacaaatgaagactggggaggagtctcactttatgatcttgctctcaaattgcttagcactcctccacttgcgaatgcacttgagacagtaggtgtggttgcagttggagaggatcccgaagcggcgctcactggggttggctttctcatagaccacctccatgcagatcccacacaccatgtccttgctgcgctgcacggcaaatgagagctccatgtccttctcatgggcctcaatgcacgactagagaaggtggagagagaacaagtggaatccagtcattgaaccctgaaaaacttgagcaacagttaatgattcacagtcaaagaatcaaatagtcaactgaaaaaacaatgttcccaagctgacacgaaaattagctttgctgacaagtaaacacaggtgtggtgttttttttttgtttgtttgtttttgcggtggtacttaacaatactagaaaatcaaactatgaggactcaacttcgggaactgaaaaattacccaattttctctaccccaaacctggagctcaactacattaaagacggttttccatactgtttgttatttctggtttctacatgaggttaagaccctagttaaaacctgtcggaaaataagggtgacaggcacgtaaactctcttatgcctttaaagaaaaacaacttcatcgagatttttcaactactcagcttgatagactgatgcacacttaggttaggttagattagcccactttggggctattataaataatgctgccaagaacattcatgtaccaatttttgtgtggacatcatattttaacttataaaaaacatgattataggaaacataaaaatgcagaaaactcccagcactttggaaggccaaggttgggtggatcacatgaggcctggagttcgagaccagcctggtcaacatggcgaaaccccatctctactaaaaatacaaaactgaggcaggcgtggtggtgcatgcctgtagtcccagctattcgggaggcagaggctgcagtgagccgagactgcactgctacactccagcctgggggacaaagcaagactctgtctcaaaaaaaaataaaaataaaaaaaataacactgcagaagagcaatgtcatccataatctcacatcatcactaaacatgtcttttcctaaacctttaaaagaaaaaacatatatacatatattcagaggtaggttctactacctcaatatatagatataacgtatagagatttatcctgcctaaattcacaaaagtacgctgaagatagggatcaaattatgtctaccttataacatgcctcacaccctaaaaccacatttaaaaagatggaaatttaaaagagatggaaatgattagaagcaaactttgctccaataaagttaaagtttctaacacaatgtcttctgaacctaccctggctcccatacactgctgctggaaatgtaaaatcctgcagccactgtggaaaagtatggcagttcatcaaaacgtaaagcagagttcctatgtaacccagcaattccactcctaggtaacggaaaacatatcttcacagaaaaacctatatacaaatgttcctagcagccttattcataatagccaaaaactggaaatgatctaagtgtccatcaactcatgaatggaaaaacaaatgtggtctagccatacaaagacaataattcagccatcaaaactaagaacggctacacgcaaccacacaaagaaccttgaaaacactatgttaagtgaaagaagtgaagtcaatcacaaaggaccacattacaggattccatttacatgaaatgtccacaataggccaatccagagacaaagcagattcgttattgccaggagctggaggaaggctggaataaagagtgactgctaatgggtgtaggatgatcaaattatcctaaaattagtaaaatggtaatggttgcacatctctgtaaatatactaaaaaccaatgaaatgtgcattttcaaaagattaaacatattcaatgtgaatctcagaaacattattttttaaaagaggaaaaaaatgttagaagtctatagtctgagtttctggaagtaggacttctttttttcttttgcctcaacctcctgggcttgagcgatcctcttgcctcagcctaacaagtagctgggactatagacacatgcctccatgcccagttaattttgttcactggaaatatgacttcttgataaagcatccaagaagcccaagaaaggaaaacttccctactcactgataaccattcaattcatcaaatgtttctctgaaataaacccacaatgctgtgaaagggcaaataatgattctcacatctaataacacacacatctccctaaagacttactttgatatgctgcgatctctgggcagcatccattggatgcaggacctgcagcccacacatgtcacaagaatctccgtggagatacacacagttctccccgtatcggcactctcccactgcagcataggggcacagctgcttctttgtctccacggcggtttgctctttctctgattcttccttggtcactgagccctgcaggggtgcttcagtgcaggaaggcgcagctgaaaatgtgtaagagggtggtaaaggtccaaatagataaggcatgaactataagagaactgagaatctaaccgcaaaaaatgaaaataaaactgcaatgaaataccaaaacagtctactgaactaacttcttcacttgaaagaaaggaattttttctaccgctgttatttccaagattagacttgtaaaaaaaaaaaattgcttctttatctatgtcttgggtaactgaaatttaatttcaaaaagtactcgaaaggattcagtttttcaaaacattctgaattcatttcactgggattaaaaatttccttcactctatctgtaaatcttaggtaatccaaattaaagtactgtactaagattaaactaaaaaaggaatagaagcagaaaggggaaagttgtcaaaactaagcaaatggatgaactgctatccagccctctaactcttattttcttcttcagaatacttactacggccacagtagggttgcccaggaacaaactcaatagcattcacccagtcctctgaacctgctcctacagttgcaaagtttgaatttcttgactcagcttcgcctgtattcatttcaacaagtggtccaactatcgatgagagacttgaggaagcagcaagggatgactttgtagttagctctgtagcagttgcttcttcctgtttcaatggtttgctatgttcatatctaagaaaaaattcaaaagtaagcagtcggccagtcgtggtggctcaagcctgtaatcccaacagtttgggaagctgaggtgggtggatcaccagagaggttgggagttcgagaccagcctggccaatgtggtgaaaacccgtcactaccaaaaacgcaaaaattagctgggcatggtggcgcacctgtaatcccaactactcgggaggctgaggtaggagaatcacttgaacccaggagacagaggttgtggtgagccgagatcatgccactgtactccagcctgggcgacagagtgagactccgtctcaaaaaaaaaaaaaaaaaaaaagtaagcactcactgcctaacttcatatatacctttttcttttctttttttttttttttttgagatggagtcttgctctgtcatccaggctggagtgcagtggcgtgatctcagctcactgcaaactctgcctcctgggttcatgggattctcctgcctcagcctcccaagtagctgggattacaggcgccagccaccaaggctggctaagttttgtatctttagtggagatgccgtttggccaggctgatctcgaactcctgacctcagatgatccacccacctcagcctcccaaagtgctggggttacaggtgtgagccaccacgtacggccatatattcctaatacattccttggattctctttgagcatcaatgtgcctgtatttgtgagtgcagagagaagcctatgattctgcatatttagttataccatgtgtgatgccaagactgctggtccagagaccatacttttgagtaggaaggcaatagactgggggtcaccaaagtttaaagcatcaaatacacaaatattttaggctttgtaggtcatacaatcaacatcacaactacaagtattcaactctgaaactgcagtgcaaaagcaggtgtaggcactatttaaaggaatgtgtaactgttccgatcaaacttgatttatgaaaacggcctttggccagatttggcctgtaggcccatacccctggctatataccacttattacttcaaattccactctaattaggagtttcagatagttgacagtctatagttcccatggtaactctgccagaaaccctgcaggcaaaactgactgatttcaaagcaaggctgacacaaggtcaataagcagacatgtggaacattttaccaacacatcaaataaaatgctgtcactattaaaaggtagagacaatatttatacaatacacaatatgtacattctttttctaagaaaatccatccattcaccatttccccttccaaattttgcccctatgcattctctccttttcatctgtaaacattaaaccaccaccatctccaaatacgtggggaaaatacatctatttccttcaagaaccttctttctggcctggtgcggtggctcacacctgtcatcccaacactttggaagtccaaggaggccagatcacttaaggccaggagtgtaagaccagcctggcgaaacctggtctctactaaaaataaaaaattatccgggcatggtggcgcacacctgtaataccagctactcaggagaggctgaggcataacagttgtttaaacatgggaggtggagggtgcagtgagccaagatcaggccactgcattccagcctgggcaacagagtgagactctgtttcaaaaaataataaaaaaaaagcaaagcatagcaagcatctttctgcctgagaaaattctcacagttcctgctggacgtggtggctcaggcctgtaatcccagcactttgggagggtgaggcgggtggatcacctgaggttgggagttcgagaccagcctgaccaccatggagaaaccccgtctctactaaaaatacaaaattagccaggcatggtggcgcatgcttgtaatcccagctacttgggaggcagaggcaggagaatcacttgaacctgggaggcggaggttgcagtgagcctagatggtgccattgcactccagcctgggcaacaagagcaaaactccatctcgaaagaaaagaaaagacaattatcacaattcttttagcattttacactaagaaattgactgattttcagagactcactctatctcctaggctggagtgcagtagcgtgaccttagctcactgcagcctcgacctcctgggctcaagcaatccgtctgccttagcctcctgagtagctgggacgacaggtgtgtgccacaatgctggtctaactttttttattttttgtagagacaaggtttccctatgttgtccaggctggtctccaactcctgggctcaagcaagcctcctgccttagcctcccaaagtgataggcatgagccaccgtgctcggcacaccgagttttattcagatgctatgtattaattatgcatatagtaaatttaactgtgctacataatttatagtttgttatcaagtggttcttataatgaaacattactaactttgggtcatctgtgttataggtgcctatgtttatacgcaaaaataaagtaaaatctaactaaaggctctactccagcttatggcaaacattttactgagctggtctttaatcattgttattattacctcaaacattcatattctagcactctgggaggctgaggtgtgggtggattgcctgagctcaggggttagagacaagcctgggcaacatggcaaaactccgtctctactaaaaataaaaaaattaggcagggcgcagtggctcacgcctgtaatcccagcattttgggaggctgaggtgggtggatcacgaggtcaggagatcgagaccatcctggctaacacggtgaaaccccgtctctactaaaaaatacaaaaaaattagccgggtgtggtggtgtgcgtctgtaatcccacctacttgggaggctgaggcacaagaatcacttgaacccaggaagcggatgttgcggtgagccaagaacgcaccactgcactccactctgggtgacagagctagactccaactcagaaccaataaagactatgcgcggtggctcatgcctgtaatcccagcactctgggaggccaaggcaggtggatcacttgaggtcaggagttcgagaccagcctggccaacatggtgaaaccaccatctccaaagacattcatattcctcctcttaagccttaggtaaactacctcgccttgcagcaaaagtaagctgagtatcctgctatcatccacaaaaacccaatgcattgttctatagagtggaatcctataagctgaaggataagggaagaaactatcatgaatatgctctttcactttcactcatgaactgtggggaagtattctatcattttagagatgacctcactgtcctactaagtgatggggttctaggtctaatgggactctaaagctgctctatacagtacagccaaccactgcccacatctaactcttcagacttacatacaattttaaactcagttcttcagtccttcctctagctatacctgcaagtgttcaaaagctacatggagctagaagctaccgttagatagcaacatgaagaacatttccagtactgcatgaagttctactggatggcagtattctgaaatgttagagcagcaagtatccttagaaatccagcccaggctggacgcggtggctcacgcctgtaatcccagcactttgggaggccaaggtgggcggatcacaaggtcaggagatggagaccatcctggctaacacggtgaaacctcgtctctactaaaaatacaaaaaattagccgggcgtggtggcaggcgcctgtagtcccagctactcgggaggctgagggaggagaatggcgtgaacctgggaggcggagcttccagtgagagagctgagatcgcgccactgcactccagcctgggcgacagagcaagactccatctcaaaaaaaaaataaaaagaaatccagcccaaagcctcacttttcattttacttttgttttgttttttgagacagtctcactctgtcacctggctagagtgcagtggtgcaatctcagctcaccggcttcaagtgattctcctgcctcagcctcccaagtagctgggattgcagatgcggcaccaccaagcccagctaatttttgtatttttagtagagacggggtttcaccatgttggccaggctagtctttgaactcctaacctcaagcaattcactggcctcagcctcccaaagtgctgggattataggcgtgagccaccgcgcccaggcccaaagccttacttttcagattaagtaactcccttggagccaagcttcatggctccagcctataattccagctagttgggaggctgaggtgggaggattacttgagcccaggaatttgaggctatagtgagtcacgatcacaccactgcactccagcctggatgacagagcaagactatcctgtcccttaaaaaacaaaataagccaggcacggtggctcacacctgtaatcccagcactttgggaggccgaggtgggcgatcacctgaggtcaggagttccagaccagcctgatcaacatggagaaaccccgtgtctactaaaaacgcaaaagaattagctgggcatggtggtgcatgcctgtaatctcagctactcgggagactgaggcagaagaatcgcttgaacctgggaggcggaggttgcagtgagccaagatcgtgccattgcactccagcctgggcaacaagagtgaaactcagtctcaaaaaaacaaacaaacaaaacaaaactccctggtttaaaagataatttccaaaaaaaaaaaaattagttatttttacaagctttatattttttgttttctttgagacagggtctcactctgtctcccagactggagagcagtggcacaatcacaattcactgcgcccttaacctccctgggctcaggtgatcctcccacctcagtctccccagtagctgggactacaggtacacaccaccacacccagctaatttttattttgtaggtacgtagttttgccatgttgcctaagttggtctcctgggctcaagccatcttccccgcccagcctagtacaaatgtctaaggaagtttaatcaatttttctgtctctgtaagagaaaataaccctttccctggttggtttacaactcccaccccattgcttctgtggcctttagtattttaaagtattggattcttcagttggtccaaaaaccaaaactccaaacaagaagtcaaccaaaccaggccaggcacggtagttcacacctgtaatccccagcactttgggaggccgaggcaggtggattacttgagggcaggagttcaagaccagcctggctgacatggtgaaaccctgtctctactaaaaataacaaaatttagccaggcatggtggcacatgcctgcaatcccacctactcgggaggctgaggtgggaggtggaggttgtgacattgcaccactgcactctagtctgggcgacagagcacgactccatctaaaaaaaaagaaagaagtcaaccaagccaatattgcccctttccccagagggtgtccagaaacaaagactgggagttctaatggcattctgggaaaatactagactagatatctgcaatatgcaaaacagtcccgagcaacaaagaactggcctcactaaacaaaagcaccaccattacgaaacactgatgcagaaaatcctctcaactgttggggctatgatgctatccttcattatcaatgatctactccctctgtgaagagggaaatccctgggctttgagcaagttacataaagagatcccaacactaagagtaagaggtaggtggccgggtgtggtggctcacgcctgtaatcccagccctttgggaggccgaggtgggcggatcaggaggtcagaagatcgagaccatcctggccaacatggtgaaaccctgtctttactaaaatacaaaaaaattagctgggcatggtggtgcgcgcctgtagtcccagctactcaggaggctgaggcaccggaatcgcttgaacccaggaggcggacattgcattgagccgagatcacgccactgcactccagcctggtgacagagcgagactccatctcaaaaaaaacaaaaaaagataaggttgaagttcctagatatcattctaacaggaaaacaagcagtcatagagcaagcctctctttaagattctttctttagctagtccacaatcaaccttttaataatcacctatatcagcctgtactcaacaattatcaccaaactttcaagtagactactatagtttctctacttcctttcactttatgctaagagatctaaacccagctcaattctggctcatcctctaaagagttctagaaaagaggcagctacatccttattaaaaggaaaattaagaggccaggcccagtaggctcacacctatgatcccagcatattgggaggcaaaggtgggagcatcagttgaggctgggagtttgagaccaacctcggtgagatagggagaccccgtctctacaaacagaataaaaaaacttaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacgtgggaagcggagcttgcagtaagccgagattgcgccactgcagtccgccgtccggcctgggcgacagagcgagactccgtctcaaaaaaaaaaaaaaaaaaaaaaagaataaaaaaacttagctggaggtggtggttgcagtgagtcgtgttcacaccactgcactctaacctgggcaagagggcaagaccagatctcaaaacaaagaaagaaacaaacaacaaaccaattaaggttcctttcaactttttctttttttttttttttgagacagagtttcgctcttgttgcccaggctggactgcaatggtacgatcttggctcaccacaacatccacctcccgggttcaagtgattctcctgcctcagcttccagagtagctaggattacaggcatgcgccaccatgcttgggtaattttgtatttttggtagagacggggttttccacaggtcaggctgatatcaaattcccgacctcaggtgatcctcctgtctcagcctcccaaagtgctgggattacaggcatgagccaccaagcccagccgccccctcccccactttcttttaagacgaagtctcactctttgcccaggctggagtacagtggcacaatcaaggttcactgcaaactctaccttcccaggttcaagtgattctcccacctcagcctcccaagtagctgggattactgacacgtgccaccatgcccagctaatttttgtattttcagtagagacgaggtttaaccatgttggccaggctggtcttgaaatcctgacctcaagtgatccgcccacctcagcctcccaaaagcgcggggatgacaggtatgagccactgtgcccagtccctttcaacttggagccatctgcatctgcctcaacgtcagaggctcaccaaaatagggaacctacctaatttcctctggtctcaaactatttggggcgggcaaagttgcctgaaaaataagatggttaatacacagagcccaggcagggggctgtggctcacgcctgtaatcccagcactctgggaggctgaggcgggcggatcacctgaagccaggagttcaagaccagcctgaccaacacggagaaaccccgcctctactaaaaatacaaaattagctgggcatggtggcacatgcctgtaatcccagctacttgggaggctgaggcaggacaatcacttgaacccgggaggtggaggttgcggtgagccgagatcatgccattgcactccagcctgggcaacaagagcgaaattctgtctcaaaaaaaaaaaaaaaaaaatgcagaggcttagcacagatttcttcaatttaaccttcatttttttcattcactccatctacacagtccattcagatgagcacttcttctgaaataaggaccaactgctaattatctatagctttctgattctatctcacagtctattctcatccctctgcttgggaggttggattcttcactctcatcaatattcaactcctcctgccccagtcacagttggcagtaactctcaaaagactagaacccagttcaaggaacacagctcccttacaattagcctcaatacctgcagagactataccactacaaagattcgtccattcaccattgcagtgtgaagttctcatgactctgccttttatattgggactgcaaaagacatgcctggtggagaggccaggtgcggtggctcacgcctgtaatcccagcactttgggaggccgaggcaggtggatcacctgaggtcaggagtttgagaccagcctggccaacatggtgaaaccctaactctactaaaaatgcaaaaattagctgggtgtggtggcacatgcctgtaatcccagctactccggaggttgaggcaggagaattgcttgaaccagggagtcggaggttgcagtgagttgagatcatgccacagcactccaacctggcgacagactgagactctgtctcacaaaaaaaaaaaaaaaaaaaaaaaagacatgcctggtggagagtttgagaataatgtcattgtgtcattttccccctttttcagcaataatgcaatgacaaattagcaaagggcaaaatgagtagcaactaaacaaagtttctatgagatcaacttctgaacttctacacagtcatttgaaaaagatcttctctttcccctcatccttactggactcttaataaacagatgtgggatgacttaacattaatatcccacaccatcaataatgtcaggttctgaactctatttgaacccagtggctcacactacattttctgataatgacattaaaattgactatgactatggcacagtggctcacgcctgtaatctcagcactttgggaggctgaggctggcggatcacgaggtcaggagatcaagaccaccctggctaacacagtgaaaccccgtctatactaaaaatacaaaaaattagccaggcgtggtggcgggcgcctgtagtcccagctactcaggaggctgaggcaggagaatggcgtgaacccgggaggcggagcttgcagtgagctgagatcccaccaccgcactccagcctgggtgacagcgagactccatctcaaaaaaaaaaaaaaatttactatgacactgtcaaaagtcttaccgagggtagtggtttaaagtacatacaaaactctttgatatgccttccttcaaaaggtagagcccaatcctctccctttacatgtgggctggacttagtaacttagtccagaatcagtggaaataacagtatatgacttctgacactaggtcataaaaggcattgtggcttttccttgcctcctctgttaaattgtttgctctggggaaagctagctgccaagctgcaaggatactaaagtatccctatgaaaaggcccatgtgggccaggcggggtggctcacgcctgtaatcccagcgctttgggaggcaaaggcaggtggactgcctgagctcaggaatttgagaccagcctggccaacatagtgaaaccccgtctctactaaaaatacaaaagttagtggggtgtgggccgggcgcggtggctcatgcctacaatcccagcactttgggaggctggtgtgggctggtcaggagatcaagaccatcctttcaacaaggtgaaaccccatctctactaaaaatacaaaaattagctgagtgtggcggtgcatgcctgtaatcccagctactcgggaggctgaggcaggagaatcacttgaacctgggaggtggaggttgcagtgagctgaggctgtgccactgaactccagcctggcgacagagctaggctctgtctcaaaaaaaaaaaaaaaaaaaaaaaaattagccaggtgtggtggtgcatgcttgtaatcctagctactctggaggccaaggcaggagaatctctcgaacgcgggaggcagaggttgcagtgagctgagatcatgccattgcactccagcctgggtgaccagcaaaactccgtcttgaaaaaaaaaaaaggccaagtggtgagaaaccaaagtctcctgccaacagtcatgagagtaagacctcttaaaaacaatactgggctaggcaccatggctcacggctgtaatctcagcactttgggaagccgaaccgcgtggatcacctgaggtcaggagttcgagaccagcctggccaacatggtgaaactccgtctctactaaaaatacaaaaattagctaggtgtggtggcgggcgcctgtaatcccagctactccggaagatgaggcaggagaatcgcttgaacccaggaggcggaggttgcagtgagccgaaattgcgccactgcactccagcctgggcgacaagagcaagactccatcctaaacaaaacaaacaaaaaaacccaaacaaacaaacaaaaaacaatgctggctgggcactgtgtctcacacctgtaatcccagcactctgggaggccgaggtgggcagatcacttgaggtcaggagttcgagactagcctggccaacatgatgaaaccctgtctctgccaaaaatataaaaaattagccgggcatagtggcacgcagatgtaatcccatctacttgggaaactgaggcaggagaattgcttgaatctgggaggcagaggttgcagtgagccgagatcttgccactgcactccagcctgggcaacagagggacaagactcggtctcacacacacaaaaaatatcctggagtccccatcaagtcttcagatgacttgctaaaattttgactgccatctcataagtgtctctgagatagaaccatccagctaaggcactcacagaatccggaaccccagaaactgagataataaatgttcactgttttaacctactaaatttggggatgggccagtttctggggctcatgcttgtaatcccaacacttttcggaggccaaggcaggaagattgcttgagcccaggaatctgagaccagcctacgcaacatattaagacccccatctctacaaaaaactaaataaatgaggtggtgcatccctgtggtcccagctacttgggaggctgaggtgagaggatcatttcagcctggtaagttgaggctgcagtgagaagtgaccacaccactgcactccagcctgggcaacacagtaagaccctgtctcaaaaaaataaataaaaaataaatttgagggttacttgtttaacatccacagataatacacctagtcatttctgaactaggaggatagaaaagccctacccaatttttttttaaggtggagtctcgctctgttgcccaggctggagcgcagtggcgggctcttggctcagtgcaacatccacctcccgggttcatgcaattctcctgcttcagcctccgaagtagctgggattacagacgcacaccaccatgcccagctaatttttctatattttgtagacatgaggtctcactaggttacccaggctggtctcaaacttccaagatcaagcaatcctcctacctaagcatcccaaagtgctgggattataggcatgagccactgcccagccaagagtcattttcaaagcattatttttaatcagtgacatataaagctatcagaagtatgtcttttacctttttcctccaacccacccctgaacaaatttataaacaaattcttacctgcagcggtctccataaatacagtaccctcgctgaaaatacttgcacactacactatacggactgtcagagaggtcatgcgagtagcgacagttgtctccttccttacaaaccccatgcataaaatacctgtgagacgaaagaccacaaaactggattaaaaccaatccttgaaaatattaaaactaattagtattcatgactaatatattcaaccagtaaatacacaaacatacgaaataaacacaaagaaagggccaggcatggtggctcatgcctgtaatcccagtacctttgggaggctgaggtgagtggctcacctgaggtcaggggtctaagaccagcggttcgagaccagcctgggcaacatggtgaaaccccgtctctactaaaaatacaaaaattggctggtgtggtggcacacatgttaatcccagctactcaggaggctgaggcaggagaactgcttacacgtgggaggctgaggtttcaatgagccgagatcgcgccattgcactccagcctgggagacagagcaagactccatttcaaaaaaaaaaaataaaaagaaggtgataagaaaacaggagtaaagcaagtgtattagtccgtttttgcattgtgtttttgctttgtagctgggactacaggcgccgccaccacgcccggctaatttcttgtatttttagtagagacagggtttcaccatgttagccaggatggtctcgatctcctgaccttgtgatctgcccacctcggcctcccaaagtgctgagattacaagcgtgagccactgcgcctggcccttgtttttgcattgttacaacgaactattttgacattccagcctgggtgatggagcacgactatgactctgtctcaaaaaaatgtaataataatacgccttagattatgaaaactgtttaacttacataacaaaaagaaaaaaaaagggccaggcgtggtggcccacacctgtaatcccagcactttgggaggccaaggcggatggatcacgaggtcaggagatcaagaccatcctggctaatatggtgaaaccccatctctactaaaagtacaaaaaattagccgggcatggtggcaggcacctgtaatcccaactactcgggaggctgaggcagggattgcagtgagccgagatcgtgccattgagccactgcgctccagcctggacaacagagagactccatctcaaaaagaaaaagaaaaagaaaaagaaaaaaagatatagtctacgtcaaagaatttctcctccaaacaaaaaccaatgaatataagtatatgtcttgtttttaaatgataccaccaaaaaaaaaaaaaaaaacatcatccagattcaccccaagttgagtttgccttcggtgaaaacctgggccatatattatttctgaagttccttccactgtgcagactctgtctccatgagacactgtgcagtaaaagacaaaatttactagaatccccctactgctgtgcctcttagaaacctaatagtggcccccaacatagagaacaagaaactgccaagttaccctgtaagggtacaagagaaccaaacagcaccctcagagtatctctaggcatcttaacaacctctttaggaatttctacaaattatagaatagataaggcatttaatcaattcatctgcagtgacacttcttactttgatatttaacttttaatgagtgagtataccatttatcaaactagattataaattcctgatgggtaaagactggtttattcccctttttatctccaactatctgtgcacataatatatacttgttagaaaaaggtagaaagccgggttcggtggctcatgcctgtaatcccagcactttgggaggccaaggcgggtggattacctgaggttgggagtttgagaccagcctgaccaacatggtgaaagcggtacctactaaaaatacaaaaattagccgagtgtgatggtacaagcctgtaatcccagctactctggaggctgagagaggaaaatcgctggaacccaggagatggcgattgcaccgagccaagattgtatcactgcactctagcctgggcaacaacagcgaaactccgtctcaaaaaaaaaaaaaaaagaaagaaagaaagaaagaaagaaagaaagaaagaaagaaagaaagaaagaaagaaagaataaaagactgtagggtgggcccggtggctcacacctacaatcccagcactttgggaggcagaggcaggtggatcacctgaggtcaggtgttcaaaaccagcatggccaacatggtgaaacccactatctaccaaaaatacaaaaattaggccaggtgcggtggctcacacctgtaatcccagcactttgggaggctgaggcaggtggatcatgaggtcaggagctcaagaccatcctggctaacacagtgaaaccctgtttctactaaaaatacaaaaaaaacaaacaattagccaggcatggtggcacacacctgtagtcccagctacttgggaggctgaggcagaattgcttgaactcgcagtgggttggggggggcccagaggttgcagtgaaccaggatcacgccactgagactccgtctcaaaaaaaaaataaataaataaaaggctgtagaagacagctagatgtgatggtgaatcatggtagcgatagcaaattaatttttctttcccagttgcataatctttttaataccatttaatatttattacttatttcctctcacaaccactatgtagtttccaagtaataaatttcactatggacgtcacagcactcagataaagaatttctgaaggatttccttctttctttttttttttttttgagacgaaatctcactctgtcacccaggctggagtgcagtggtgcaatcttggctcactgcagcctctgcctcttgggatcaagtgattctcccacctcagcctccagagtggctgggattacaggtgcccgccaccacgcccagctaatttttgtatttttagtagagaacgggtttcgtcatgttggccaggctggtctcgaactcctgacctcaagtgatccacctgccttggcctcccaaagtactagaattacaggggtgagacaccacgcccagctgatctttaagttacgttaaccacatttttaaaaacttttgaggccaggtacgggggctcatgcctgtaatcccaggacttcgggaggccaaggtgggtggatcacctgaggtcaggagttcaagaccagcctgggcaacatggtgaaaccccatctctactaaacgtacaaataattagccgagtgtgatggcacgtgcctgtaatcccagcttctcggaaggctgaggcaccagaattccttgaacccaggaggcagaggttgtagtgagccgagatcgtgccactgcactccagcttgggcgacacagactccatctcagaaaacaaacaaacaaacaaacaaaacacaactttcaaggccaagcatggtggctcacacctgtaatcccagcactttaggaggccgaggcgggtgaaacacttgagcttaggagttcaagaccagcctaggcaacagggtgaaaccctgtctctatcaaaaatgcaaaaaaaaattagcctggggtggtggcacgtgcctgtaattccagctactggggaggttcaagcaggaggattgcttgagcctgggaggtggaggctgcaatgagccaagacactgccactgcattccagcctaggggacagagcgagaccctatctcaaaaaatacaaataaatacaaataaaaatcaagaaaagagttttttgaaaaattaaaaattaaacacttgtttttttgtgtattatttcaactaccagaacacttatctgccattatagaagcactctaataaagaggggtctaaattcaaattacaacttctctttaagtattaactgttctaacctcacacactcaaggtaactcaaggtagcagatgcaatgagcatttctgtttcttagtattgctctaataaaagatatgaaaaacagcctggtggtggcagcataacacagtttctgaggaaaggtataaaacacaatgaaaaccccaggagaaacattagaaaaaatgtaaccagtaggaaaatacaggtgattccgagcaattaaaaacattctaatcaaaacttctaagtgaagaaaatagctttagtcaaattcctagatacaggagtgatgtgctatagggagaaatgagcacaaacactaaaacacacctctacctgattctttaggtgatgtttacctagcaaacatattgaaaatgtttatttataatacagtacatacatctgcactctcttgaacacctaatattgtgtctcccattgctggcgtgcaatgtttacttactgaatgattgaataaggtagttccagaaaaaatatacatgtggccgggcgtaatcccacctactcaggaggctgaggcaggagaatcgcttgaacccaggaggcagaggttgcagtgagctgagatctcgccactgcactccagcctgggcgacagagcgacactccatctcaaaaaaaaaaaaaaaaaaggaagatacacatgtgttctgttaagtactttgtctttggtaatttacaagttttgttttttttttttttaatgaaagcagaggaatcttacaaagttcctgttaaagtgggtaattctaggtatatgactttatcaacatcactcaagcatttactcagtatctgctcaggatactcagtaactgagtatcctgttcatgatactggaactgaggaaagaaactgaggaactgaggaaagaaagccctgcagataaaatagggccctactcttctcagagagctcaaagtgaacgataaggatcatagaccgggtgcggtggctcacgcctctaatcccagcactttgggaggctgaggccggcagatcacctgaggtcgggagttcaagaccagcctgaccaacacggagaaagcccgtctctactaaaaatacaaaattagtcaggtgggcatggtggtgcacgcctgtaatcccagctactaaggcatctgtaatgccagagactgaggcaggagaatcaattaaacctgggaggcgggggttgtggtaagtagagatcacaccattgcactccaacctgggaaacaagagggaaactctgtctcaaaaaaaaaaaaaaaaaaatgatagttgacattcctctatctaaaggagaaaatagttttaagtaagagatcatgttggtacctagaacaaccgaaaacaatgtcaaacactaaaaccccagacctatcaaggaatctgcacaacaataaaaaactgtctcaagcaaaagctatacaaaaaacccccaaaaactagtaaatctaagctctttcttttctttctttttcttttttgtttttcttctgacagagtttcactttcgcccaggctggagtgaagtggtgtgatattggctcaccgcaacctctgcctcctgggttcaagcaactccctgcctcagcctccggagtagctgagattacaagcgcctgtcaccacgcccggctaatgttttttgtattttcagtagagacggggtttcaccatcttggccaggctggtcttgagctcctgacctcgtgatccacctgccttggcctcccaaagtgctgggattacaggtgtgagccactgtgcccggcctaatttttgtattcttagtagagacagggtttcaccatgttggccaggctggtctcgaactccttacctcaggcgatccgcccgcctcagcctcccaaaatgctgggattacaggcgtgagccaccacgccgacctagccaccccgacaggccggtttcaatcttttaaaagatgtaactagcacatatagatcaactgtagcattgtaaaagggaaacagatattcaaataatttgctccatgagtagaaactttaaaatcatcattcctggcaatattccacttttacaatccaccgatgaataagacaagtgacctgaaattgcgtttatgctttctacatcccattatgtaaaataattaagcttatccttcacaccttaaatgtatcatatcaaaggctgagagaccttcgaaggtcgccaggataaatgtatcacatcaaagactgggaaggtttcaaatttcacccttaatactacaagttctaattaggaatcatttttacatacttgcatataaattataccacccaggtgaaaaccggcatttcagttgatttattcaactgatagaaaaagaaaagcttacagtcgctactgatcactatttaaaaaccggaaaataaaaaacgtacaattaaatgccctcttctgcgtagagctaggtagttttttacaaccatacacatccatacaaccgccatcccttaatttttctaatattttcgtctcgcatatcaaaccaaaaccaaacctctctctcttccgggagcgaagagccctttcactcccttcggaagatgcgtaaatttcaaaagaggaacatagcgctgggggagggtaataatctgcagctcaaaaaaaccgcgggtggagaagacgaccccggcccccgaacgcctgcttctaagacaaagctcagcaccgccaacctcgacaaacatacaaagaagaaatacaaaagcttcttctcacagttgggcggaggatggggggcggagggacggagggacgtgaaaagacgttacaaacggatggcacggagagaggagagggccgggagccaggcaagctcgctggggccctcggcggggtgtctaggcccggagaggatcgctgggagaccggcctcaagtgaccacctcccgagccccgggagccggaggcagcggcgggggcatccttccagcggcaggggaggagccagcccacctctccccgatgcgctcgcagccagctcaggcagcgctcagggaagtgtaagcggcggtgcagccccgcggctccgcagtaatcgcgcaccgccaggcctccgcggacagcgctgagggctccgcggcccagcgggggttgacgcagtgactgggggaacgcggcggcagcgggggccgcgagggctgcagagatcgagacaacgccggtccccgccctcccgcgcctctagccgcaggccggccgccctcctccctcccgcgccgcaggcttggcccgcggccccctccccgcgcccggcgctccgccgcgcaacgtcctacctgcaggtgacctgtttagtccagccgccgccgctgccgtcgctgccgccgccccctccgcccgcccccagggacggggcggtgactgtggggatcggggtgggggaggctgctgccgccgtcgccgctgccgctcctgctcctgatgttgtggctgttgttccgggagttgcagcctccgccattactgtttatcccacacagcaaaggccccggaacttccgggatcacatagttccggtccggctgcggggagaggacggcgaggccaggcgaggggaggggaaggacactgaggcacccgttcggtccccgcctgctacgcgtcgcgtatctgagcgctctcgccacttcaactgcgggcccagagcatgcgcgcccgcggcccgcccacggcgccgctcattggt

SEQ ID NO: 144 - DNA, 461286 bp, Homo sapiens
tcagtgactgataaatctttaatataaaaattgtacaagaattttgatacaaattacaagaggtatttggacaaaatatgaataaaattccatttacatccccaaacccttatgcattttatgcaaaagacatactgtaggcagttatagtacagaaaatacaaccaaagtaacagcaaattaaaaaatttaattaccttagcctaccaataaaaacaaaaagcaaaacagaacaaaacaaaaataaaacccttgttcaaggtacatacagtatttaggaagctaccaacgtcacaatgattagatcagggtgatgcacactgtcccatcccttggtgcagttaccttttgaagtacagactttgattctgcggcaggcttattgcaagagactggttttatgcagatgagaacaatataaacaaaaaaaaggaataaacagctaaactctgggagagggagaggacatatcttagtgaaaattccttttcttcaagatatttcaactccctctggccacttttgctgtcaaatatggaggctgagtccaataattttgttactggagacacaccaatgggtctggagtaagaaaggtgtgtgttctcccagctgtgtgagggatcttgctagttctaaaaggcctagtccatcaccagcaggagagaacagagaactggctttcccagatccccaaccagccccttcccctcacctttggggaggcagaaaagcagcaaggacttcatggaagaagccaggcaaggtgtgaggggagaggggaaatgggcatttgcctcacttggaaaccacccactggtgtgtcagtcatcctcatactgctgagtgagctacacatgaaaagcccaggtcgtctcaagcccaagtcttctccccatttctcgaccgtcctcacccctctgaccttcatgtacccaggtttagctctcctgcattctttatactggcactggcaggaaaatggtgagattctctgcagggcagctgaaccaaagtttgcacaggaaagcaaatgcaccatatactagaaatcttagatagtcttatcaggttaagatataatactagaacatctcattcacttaattcacgttatgcaaaccctggacagggtagaacacgtttccaaagcaattaaaaccaagatgagggagggcgtgttctaccttcttgctcaaacatgatttattttttaaggggggttggtgagatccgaagagcaaagggtgggattgagaaagacaatggaaaagtcagaggagattaagatacacaatgagaggaatggattactctgtacaaaaacatgcaaaaatactccaaattggggactagatttaaaaaaagaaacagccttggtgtatacatctcaagtgaacctattaactcagcacattgtctgggagctcaagagcatcatacctcatgaatcatgcttctcgcagtggccacagcaccgattcacagatggggtagaggatgctttgtctcctagcatggaaaaggcaggcagtgaggctcccactgaaacagtgccaggtcagttcaccttgcagggactggcgctttctccctctcttttgaaaaacatatccagggccagatgaatggagctctctcacacacccagggtctccccagagtcacctctcaatccttgcattccatgacagaagtgggcagagccagttaataattgatggatttgccatcttagctgtgcattatctcaacatcacatttggcaacaggaagccctataaaatcttggtatagcacttagatactctctcttcaagaaatatactttcaatactatctacttctctccatttttcttaaaatacttctttctgctcttccttcccttcaaagattcttttttaaaaaagtgaaacaaagcattaaaaaaactattacaaacgtccttaagcatccctggtattttagagttaaggggagaaagctagtatcagcgagcagaacttgtgcaattttggcaactggtttttcaattaggattctattaagatgtctgataaacgattgtaacatatacatactgaggaacttaagaagtatcatgtcaactaattgcctttgctcgaacccaagagtccttgctcaaagtgcttttcttcccagtccccacactggttcatgaaattatttagcacagatttgtcaacatagacctgttacattgtctatccctaaatctgctgctgttctctccttgctaaagttcatatggaagatgataccgatacctgcacgtgtcttacctggctgactaatatcttactgaaatgtgactgtttgtaatggggccaactatcttctctgagatgcgctgcgggaaggttggaaggaagcatggcatcccctagtcccagaaagaagacgcttgatagatcttgcacttcatttagtcactaactagtcactttccaaccatcatttgagtatttcaatatacaaaaatagcagccaatctttgggctcagggcattttggaatataacattttcatgtattcttcctttgtacctttggtccccatcactcgattttctaaagctccctgtacttgtacttaccaaagttcttcaaagtggagaatttaccttttactcatagggtggtccttgttttaacgattaaagtcaaaagcctgacgccatcttttttagattgtcagtccagtttgacaaaagttaatctatcatgttacactatggatttggaggggtcattgaaagatgcatttgtacacctacgtccatggtttgatgccaaggataagaaaaaaaaatgaccactgtgcgtaaccagtttacaacatgtgcactttttgaaggggaagaaaaatattttaatcttttccctacagattagggggcaatataatcttacttatgccactgacttgcaggaaaatttgctctaattatagggccacacccattactctcaagatggaattgttaacacttaagttttcaaagaagcaaaggatgccgtcacagacagcatctctctactgaccctttatttaagaagtcatcttgttactgtccacttaatagctggagagggcatcgagaggcagccttgggcttcccacagatacagtaggtgtgtgtatgtgcttgtatgttaggaggggagaataagagggaaggagagagagaggggagagagagagagagagagagagagagagagagagagagagagagactgactgattgtggatgtgtgtgtacatcagggaactcgatgggaaagcctagcccttgtagtcaatttctccttcacaaggggataaacaggcaattacgcatccttttatatttgatggccaagtgctgaactggaaagcacactattagtttgtgtcccttcagggccagggcaataagtagccaggagagctgggctgaagcagagagggtgttgtctgctgttagtgtgacagtcttgtcagcagcgttcacattactggaaggtaataaagtgacaagtatgttattagaaagatacgaggtgaaattgaactgaagcttcttgctgctcagccctggcttttttctttcctcttttgtaatggtccactatttgttacagactgagccttggtcttcatatcctatataaaaaagatttttttttttcctgcagtaaaggtcaaatgaatttacaacagcactttagaggagaagaataaagatagttttatgacaactatagtatgttgctccaaaaatatatatagcattataatgaacaataatgctgatccaattcagtgtacatgtaaaaatgcttagttttttttttttttttaacctcctgttatttggatttggattaaaatcatttggattaaaaaagatttggattaatcttttggattaaaagcatttggatttttcaacaaatgccaaaaagacagtatgccgaataacatagttattgccgaatgagcacagaaaatcattttgcgcaagatgtgggaaggatgaggatgatgaaactacacaaggaaggacgggtatgtgggcaacagtgatgacagataactcactggtcagttgtacagctggaattacacaatactttttgaaaatgaccatttatggtgagcaacactccagctacaggaaatatgcgactcgtctgggacagatcaaacatgaccttagtactaacgcaaacaagactaccacgtgtggtttatctctgagggaaaatgtgaagagaagttacttacatacctcatagaacagtaaatgagctcccattttgatcaaggtctttagcctagtattaattacaatcatggctttgttgtgttgctacagtggcaagcatgagtaatgatcaagaaaggaacgatccatgctggtgccattcgcacctactcctctgttaggatgaaaacgaggtgttaccactggccttttctatagccttgctgacccctggcatctttcggttctcaggggattccagcaacacttcccactcaaaaacaaagcaaaagcaaccaaaaccccacaattgtcggctcttcctgaccccaaaggaacttcagctatttcatgcagctgtacttgctttcctaaccccttcctcagagccgactcacctggtcataggaactctgcaggtccctacgatcaatacgctctcacccactgcgaggcagagctatgccagtcttttctctcgagccaacatttccagtgcattcatgatttccttttctagctaccccaaaaccagggcaggaaccgaccctctacttagttctgatgaaaacactgtgatccctccagtctttctggtatcttttattgctcatcttactcatttagatccatccccaaaaaataaacaatgagagggaaaagcaaaaccacctaatttaaatacttcaagtttgggagaagataagtgattttaaagaatgaaattcgtttgtcataattttaaaaaagaagctcttaagaaaagggtgtgaccacaggatgaaaaaaagtttcttctggatgatttgtttcttgatgatagcagatgtagcgtgtcttatgacaggtgaattttatttactctgttagtcaatctaacccaatgctaacagaccagatacaagttaggactgctcaggtcaagctgtcagcagttagcagcatgtccatctcaatctggtgactagcttctttatgctttaattgtcaacggccctcattctcatttgcttggcacatatctggggtgtgtacagagaaaggggaaaaaaaggtcacattgtatttggtgggaacctagtgcatagtttctcctgaggagaagcctctggaatagcccattcttgatatattcaaagttttttttttttttttttccttagagcaatgtataataatggggctgttaaccagttaagtgcctttctcctcttactggaagggcctgaaaattcatgaccaaagaaataacactatgaggacagtggcaccattgtgccaaaaaggttttaaaaaatgtttgccatgttgaaaaggaaaacattaacacctttaaacctttaaaaggcatcaggctgaacagggcagctggactaagatctggaatgagttacattgggttgacttatttaaatacaattaatatcagaacaaagaatgccaaggatttttatcacacttttaaaccaaattcctcattatctatcctttttttctctctttccatagcatgcagatattcccgaaagcggactaaacctgatatttacaaaaacatagttttaaatgatcaagacagtacaagtttcaacatcagctagagaacatgcacagtcataccgcctaattttgtacctgtgataaactctggctaaaaccaatcacatggggaaaagcttgtcggatgaacatctacatcactattaattttcagccagcatagaatgcatgtggcttgagagaaactgtttaacaacaaaaaactcctatgaaaaagcaaatgagtaggaatgggcaaagatgagctccatgactaaaacgctgatctctttatccttcctgtttgcaaataagccatgggatcaccatcttaactagaattctagttaagtcaaaacaagacactcaggcacacactcaagaacgagcaatactttggaaacagaagaattgtacattttatgattttccattgcatgtactacatccatccactcccctgtcccttttaagcaaataggctttatattggaaaatgttatttactcatttagaaggccaccgtaacgactgggcacttgaggcacaaaagtagtagcaaataggggagatacttaaaaagtgtcagctgtccaggacttattgccacttctctgacaaaacacaggtgaacacattcatgtttccaagcaagggaaactctacttctagaatctcattacttctggactttttctaactggctatacacattagcttggtttgcagcaagtaacaaacatttgttctaagcctggtgcatttgctgatgtgactgccgacagctatgtaattcactcacgagggctatctgaccttttatttgacattaaattaaacagactaaacattgctgttgtacaagatgagttctagtaactcaactgagtgtaacttttcaaagttgctgaaataaaaatgtgtatttattttcataaaactacatgtagtctatgcacactgcaaaagccagagtttctataatgttttgttgggatattaaaaatcttttcccaccctttttgaatctaaccatttggtaatggggcaacagcacaacacagagaacgctgagaggaccaaaatgtttgcaaacaaactttcattattctagttcaatctttcacaaacatactgtacagagtcttatatggtataaaacaaaggaaaacatctgtctgttcaatttaacacaacaccaaaataaagcaattaagactttggggaattcaaagtacaagaaaacaaaaacgattattactaattcctcagctttttaccataaacacttgtcatttaacatagtgtttgatatagtttcttttgtactgcaaatacttttggtctttcctccccgtagaacaaatgaagaattaaaatggaccccatagcatcctctgaaggaggtgaaaagataaagctcctagacatagctagcttatctttaagaatctattgtttctgaaattttcacaacaaaaatactgaatccccaactaatgatgcttattttgggaaacaataaatactgtgaggtacaataaatcctacaggaataataacaacagaaacatattaacagtttcctttggcaaatttaacggaagtgaatgctgatgtgaacatagaaaaaataattacaaaaacatgaaaaatggaaacgacataaaagttaaaataaagggatatttctaacttttagactgatgaaagaaatgtctgaggccattaaatgcaaaaaagaaatacattctctttaaattattgtgtactgtttgacaaaatattccttgtttatctcttcttttcccctccacttaaaaaaaaaggaaaaaagaaaaaaaaaagacaacaaaacagtctgcaatgcacaccctaatggttttggctgcagactgaacttgagtaaatatcatcatttagtcagtatgttgtggtagctgaggctgccgatgtggttaaccagctcaggcaacatgtgtaaacatcggaaacaaaacaaaacaaaaaaggtttggagaatagtctctctcctctttctcactctcaattgcttggtttcaggcttgctttcatttctctctgacaaatcgtgtggggaaacacaaaacactgaacattgagagatcctgctttaaaacccccttcttctggcttttcagaaaggagtgttgctccattcaagtttagcacatgttttcaaagcttccaagtactgctgctgttaaatgccttttgattttgtctaccaaacaggcctgaattatagtacgactgcagaatttgcaacaaattagacagccatacaacagaccgacccagttcagaggatttctttttaaaggataagggttagggccttggaaatgagtgttcgactcttttactgtattcatctttgttccgtagcgggtaatttgggcttttgtatcctgaaatattatcctgcctctgaagaataaatgccttggctgtttcacaccacataattttgttttccttttatgtaacttaacgtataagcaagaaggatgcaatgttgattctaataacattcggcacttgaaagaatcaccaagtgtttttttaaaaagcggttttctggtggccaacaaattggcctgtggttatgttgagtgactaattgtattttcttttctggaaacttgtgcaaagttggcagttttgtgttaacactaatactttgtttggcatttgtgccctatactgaccagaccatttttatacaagtgaattttttttaaaaaagacacttactgaagtatggcaatagtttaaggataaaaaagaagcatggttattacacatccccttgtagtgtatgaaaaaaagtgcatgacgggatttatgtactagtacaggacattttaaaaaatcagatctgtgctgtaaagcatgccagcacctctttagcactatatctaacaggtagtaaaaacaagaccatgtttttttctttttttaaaaatgtgcattaatgctaacataaatgaatagagctagccagcaaactatcttttcctgcatatctaacagctggatgtaactgtaaaaattaaacaaaaaagttaaacaaccatcaatacaattgttttacatcaatggcccctcaaggctaaatatttacaggtgaatctgccatgctttaattgaagattctttcaaaaccttaaagttcacaaaagacaactataagaagttcctttttgtttcttttttcttttttttcccttttatttttgcaggcaacagtcatgggtacaacaaattgtctctttggggaagaccaagaattattctgtcaaaactggggctagttgcacactgtgtgtgtgtgtgtgtgtgtgtgtgtatgtgcatgtgtgtgtgtgtgtgtttaaaggggtactctgttttcaccctgaaatcaaagatcccactcctttcccaaaactataaagggaagtgaaaaaaattcaaaagcacctagtgtttatcttgtttatctcaaggaaatacgtgtgtgtatatgtagccacagagcatacataaatgcacacacacacacacacacacacacaccccaagtacataagcgcacactgactatggcagttcaaacacgtaggccatctggtgagagctggcatttgtagtgtccattctgagactaatctactgaagtgaagggaatgtttttgtggagattagggttctgactgtgccgatttcggcttcgtacagaggaaaacatcatattgcaacctgggactttgcacttgtgcatttctctcaaatgcacagttttgtagtgcactctcagggtccccttgttgctgtacattttgtggcaaatgttgcacatgatcccaccattgctcccagacaagctgctgaacataagagatcctgaaacttcagcccctaggctgccagggagggcaggggcctcggccttgtgtgccgactccccactgtcactcgccccgtcaatgtcatcgagaagaatcccctcatcgctgcctgcgtcggattctctggaggaatggatactgctgctggactggaggctggaggtggtgctcaagtcaaggaccatgtagtcctctgccatgcctctcccatacccgttcaggtgggagtcttcagtccctgcgggagaggaggcgtcttccctgacatcgagccccatggggtgctgggcaccatatatcttcaccaaaaattcatcgcggaggtccttgctaagggagggctgcgacgagtccaggcccatgtcatcgagttctttggtcaacagtttacgatgtaggtttatgttggcactgtgtctaggaaaacaagagggaagggggggtacgtggatggggggtggggaaaggtgagaaaaaggaaagcattttaaaattgattcagctttcactaggtatcaaataagcacattcacttctaattacaccattataaaagcaagcattcccctatatcctcaggatctgggagttagtggtggtggtgagaggtgcaatcaggggaactttccattaacattatttttataagagagttgactctgtcaatggtaggatgaatgcaaacccgtgcacctttttctcaatgattactctgttagttttactatgtagcagcatcagctgcagagaatttcatggcagagattttagaatatatattaaataggataaaagaatagaaactttctgcttgtctaaatggaatagtctaaatttacctaaaaacaagaaaaagtaaacatcttttctatacagcacacactttattttgaggtatagaaaaaattcattttttaaaaaagtagcctagataatttagatataacttcaaaaaataatgaaatcttccgtctctaccctccacatttcaagttttaaggaaaaacaatagcttaacagattaagcaatttgaaatagggttacagactgtcttttaacaacacgaatgccttttctcagaatgatttgggaatcccagttaaatctaataataaaatacatttactttttagaagtatgtgcattttagtgtccaaaatattttcatcgagtagttctactttaaaatttaattctttaagacaaaaacggaaaaacagaaactttttaaaaaaataaaacccacccacctttttaaaaaaaatcacactgaacaacagaaagaaaactcagaggtacaaaaattaaaacacagtaagtacaaaaaaatcaagcacaacaataacatagggttcctttactttaacaactggaacccatacttcttcgacaagcaaaacttttattctactcactcagtgctttgcttgtatgtatgtatgtatatacatacacatatacatatttttttacatatatatatataaagacaggatttgtcccagagaatccatagggacatcatgatttacaaagcctgatatgttatcatctatctggaaacattgtctttgtatttatatcccccattatttttaaagtgcccttgggcacatacctctctccacctgcaaaggctcacatgttcaacagtacctaaattgaaggttacccttccaaaaaataaactgacatatctacagatacataaaagcttctcaatactggtggaagctctacagcttggagaagtaattgtgataaaagaaatgacctaaatggctgatataaagttcaacagacctcccgattatacttaaaagtatggaagaccaaaatgtgtcattccatttggtgacaaacgtgggtgatatttcctagagatggttgagaggtatgtgcctcagagacaagaaaggtggggaagacttctccacctttccacacaagacaatatacagcactctgggttttaaggggcagagggcagcagccctctccaactgcacttaggaaggctgagcttaccttgtgacaataagatcagctttctaatcttttgctaaatcgatcacaaaagaaagcaagaataagagacagagagagagaaagaaagagaaagagagagagagaaaacaaattcacattctagacatctggttttgaaaaacttaaacaataaaatagggatttaaaacgttctgatcacaaaattattttctgtcataagcgatcatcccatacgctgtcttgatgattttcagatcagctgtataatccaaaaatcataaatcgaattaacacaaaccaaattcacagcatcatcatccacaaatgagttctaaacagatgcatgcagtgtgtgggtatgtgaatgataaacagaagttgtccccacggtccctgctctgacacagtaattccccgtttccttggtgtcagatggcagatgactccaagtgcaggttgctaagcaaagtgcaggaaatgcctactgtgaggtctttactctgacatgtgggtacaacaccaccagttattacaagaatgtggaagtagagttacgctatgcgctattattctattgataaaactatctgccaactatgagcagctcatgaaatcctacccgtttattatttttaacaccctccccctttcttaatttcacgagcacacattttgcgatgactgtaatctagaactctgttgcttctcacacatctgcagttaccacttcctaggttcactgctgagaaaacagcagccagacacacagcagttgcatcaagacacactgaataaggaagaataaattaacattgagaaaaggacacactgatcacccagatggacacatcttccctaagatgacttgtgaaattacacatctccaccaatatgttaccagaaagagattttctcttcatttctcacttacagcagtagaaatctgtaatctaattagacgatgtaccagccctcaatatctgtcaaccaaacgatgtgcagaaatgtgtagaccagctctggcactctgttcaacagtgtcccttttccgctgtcagcagtactgttggcctctgctaatataattacattgacttttattcaattaagtgccatccctcactttaaaaaaaacagctactttatcaattgattcaggtgtaatgcaataataaagatgaactcatggcagtgcattagctctgctcttcataacttcagtacacgggttcattcatggtagtcgatttccattatgcaaccacagttcaagagaattgattcttttacgttcaattcctaatctatttcatttttgtttaataatcctcctaaatgccatatgcaaaacacttgaagtggagatgggaaggatggactgaggaaagtctgctgttcactctcatgatagtgggcttgaagattttctcacaaactcacacagtattcctaaggtggaaggaaggaaagcacgagaaggaaagcagactaaaattctttagagggtaccgatcctacccaagaggttacggttcagtctccaaagaagggacaaaagacagcacttgattttaacaaagacctattgttggactcttgaatcagtcaatccagaccattagctgtcataaaatactgtcctcatgagacacaaagacctagggttaatagcaatttgaggactattacaagtttatccggatcagcaaaactgaagaggtgaaaagagaagttgggagagacacagaaagaactctcacctactgataatcagatgtcgagagaagaccctaaaatggcaggaaggccagagagtgctggaaacaggagggggactccctggcagaggaagccctactcagttgtatgtaacaattggaacaaagaatccaacaaggaaccaattttgagctctccagcgacagagatggtttttctagaaacagatttagtgttctgaatatttatctctaggaaagagggaagaatactcaataacaaatatctaagactgtattagaacttcttacattctataagaacatgaacagtagaaaggttgtttctacttgctttgatttggaaggcaagaaagatatatggaaggaagttcctcttacagaaaaaaagtgactggaatgcagagagaaaatgagttcataggtataaggggtaaggacttggtcttaagaagtgcagtggtaatcattaaggcagtggtccaaaccttagccccagacgttcactttcaagaacataactaaatcttactcaatcttatgtgtcctgcacgtaaagtagaatactttgcacagaggaggtacttaaaagtacattggtttcccttccatcaataatatgcatgagtcttcaaaaagtatttcccaaaatacactgtagaagggaagaaagcaatgatcccaaggtaggactcatgtaacagaatatccaaggaaaggtggtggcgacaaaacaaacggtgatcctgacgctattaataccatagtatgttataagggaatgccacaaaattagggcttgaaaaagccctgtaacttgggctatgcttggaactacaaatgcttcctttaaacctctgtactctttctatactgtgaatctaccaaaagcttgttaaagaccaatatcacccttaaaagcaaaaagttacaaaaccttggactgaggggagggtgctgcagaaccaaacttccttcttctttgaaatgctgagtggaagtactctaactggactaaagtggactaccagtctttttctgttcctttgatgaaaactttaccatgcaaccacagaagacatgaaatccatcaaacgtagtcaagtaagtgcaaatgccctttagagagaaagcaagtcttgccttggacttctcttttctcatcacattaagttagatttaatgtgatgtctggcccataaaactaaaaacaaaaacactatctaaagaaagtgttttgaggttttaaacttggctttaagatatcggggagacacgaaaaagaaaaaaaaaaaaaacaagttgcatgaccaaattagaaagtaagactgtggcagtcagagactgaataatgaaccaagctataggttgcatgaagtgtcttaattcttaatcagatttgagacattctgaacttggtgaattgaaacaaaatacttaataattaattagaatgcctcaagggaaaaataactgaggccccactttggattagtttttgcctttattttccagctcaactctgccgttcaacacacacattcacaaattctcaaatgatattgtacagaatgatcataacaacatatacatagcgtaacaataacatatacataccatatgcatgcctatttgtctgtatgtatgtgtgtacatatatgtatatggggagaatgggagagagagagataaatttatatccaatctgggtaagtctagatgctagggttaagtacattgtaagactactgagtcaacaatacttttgagtagaaatgtaaacctgctatcaaaatccacagaaatgaaaaattaaaacttctgccttcattagtccttttcttatctggattgctacaacactatctattacacttacctcaacatttttgtattatcatttattaacgataggatgcttatggctctgtgcacaaaatgatacttttgacactatacctttctgtaaaattagtagttgttctacaggttattatttaaagattctgtccaaaagatctgaaaaccatcccctagctcaggaagaaaattcaatgtgaaattctagtgggtaacactcaaaaagccccaaatgtaaggaagtacatattaaatgcaagaaacaaaatctaagcaaattcttgcaaattaaaagtatgaaactcagtcatttcaacccctttcaatataaaacaaatcatccatactagtcacgcagacagtttcctctacattcaaattattcacttgaagataagctcctaccaaactctttaggggtttagctaatttactgcacagatacggcacgtctgttgtaataacaggtaggatgtattggggtcgaccatttatcagaattagacttcttttctcaattcacagtgaattatgctgcctacacgactcccctctctcagagcctgccatccccgtatggcccctaatgtggcaggcagacaaaattgacagtctcatcttgtcaacaaggggcgattctcctgagaagccatttaactttgcaggggaagcaatgtattaatgtgcttgtcccaggaatgttaatcatcttcaagcttccgatctaactttgacgtgaacgaaatcaccaaatttgtttactaaatgaatcgtaatatgctaataagaaagcatgacatatatggaaaagccaaacagatggtttgtttactccactttgcaactttataaatgttgtaactctgaagacgttagtgagaattattggtttgttggcagaggcaaacatgtctttcgcatactaaatctggccctacagttagaaaacaatttgtcattgctgtggaatgcataaaaaatgttaatgtagtgatggcatttgggaaggcagattggtagatggaaaatgtgtagctggatgcacaggttaagtgtagaattgatatccagcagccccattccctaaccattttacttttgagttgtatctgagacatcgaggcttctcaagggtgctgattattcaataggtacctgttgcgctgtaatgtgagatgagtgttacactgtgaacaggattatgttttcacagcatttggaagtgttctcaatcaagcagctcatatggtgctcagtttactactattgttgggtaagaaaaagcaaagccatgagccctggcatcttttaaggacttactgagaataaatctgagctttgagttttatatttacactggacaaattaaccctcaagctttccattccttgttttatatagccttactttataaagattttagaagatatatttccaaaataataggagctaatttttacaggcatgtgccaccatgcccagcttttttttttttttttgtcagtatagatgggtttttgctatgttggccaggctggtcttgaactcctggcctccagcaatctgcctgcctcagcctcccaaagtgctggaattacaggtgtgagccaccacacccagcctaaaatggttaatttatgatcttcttaaaaggtaacagtcaggatgcatgagttccccaagggaggtgacactattttgtaggacaatcaatattagtatttagctatggctttatctagaattctgtgttgaaaatgaaactaataaagacacctgaacaaaaagagtgagcataatctaatttacaactttgattaaatgtcaaaactaccagccaaaacatgaaaacttcatttaaccaaccagcaatgcatgcatgctactaaatgttttaatatttagaaacggatgatttttgtgaagttctttttactttttatttgcacaggcagagtctgaaatgcaggattttgtattaaagaagtacttattccctctgatgttattaaccactcccaacatcccagtcatacagatacatgttgagactaccactaatcttgtgggatttcctggtgtatcaccatatagcactgaactttttacccgagaaatgagagagcaaagtgatctaaagaaaccactgagttcatcttgctgcccaaggatcactttgaagcaagaagcattagcaactgttccagcctggtgcttatatctcatttgaaacatctcattcctgaccaacaaagaaaatttcaataaagtacttttactgatttaacaacagtgagcccttgggattgtcaaagtgctaagccttttccaaggagagaagaaatcagcagctcaaatataattaaccttccattctcaatgcaaactgccacgcataggagctctgcagtctattagtgaagttataatggccaacaggcagaagcaaaattggtcaaaaagttggctgctgctgtcatatttttggaattatgattaatggcactaataatgtggatgattactgatatgtgtgtttccagcagtttatcatattgctttggctgcctacgtccacaataaacaggatactatcatttacctctttattgaaggcaatccttctcttgaaggagcatattctaattacttcgtaatgttttatgtcttaaacattttgcagctctggaccttgccaactgcttcgtgtctaccattgattaattactgaatgtttaatcaaaatttagaaactaatgtagtcatttatgagcacattgcagtgccaaagtagttaggctttgctcccaagtttggagagtgttgggttcaaaatcaaatcccagtcacgcatgaggatccaagaatttcaccttgggtgctctgaggttgccaattccatctctgctgatgaatggaaggtaatctaactacagggtaaacagcatctttacctaccctctcttcactggatttccctttcctctttcctcagttccctaatcaaccgagcaccactgtcagctgttgctgagaacaagaaagtcctcgtgaacacccgtcatgagaatatagttttgaagtggttaaacaagtgaaaaataatttgctgggacaaatacataagttttttttaatgtggattttttatggtactgtcatacaaccattcaccattgaagttaagtgtttttttaataccattactgaactgctgaaatggatgctaatatagcttggagtgctaatgtcaagtcctggtaataaaaaagacagactgctgaatgaaataatttcaagtaaaaaatagaacaaaagtgctctctctcttgctctccacttttattgaattgggactgactgagccaattgctttagaagtctgtaaaacacaattacgagtgagcgaactgacccaccagtgccccctcagtgacagagcagactaaaaaggcagcagagttagagcggctcccctccactgcccatcagacctacagggcttccagctgcaggtctgtggttcttggtgcccaaatgggtcttgttttacttacgaaatcttatttcccatcaatgtgataaagttacttcatacatcactttccgagatgtagatgtctattctggcaattaagaatgatctgtcttttgatattcttatttatgtggatgtttatgtgtaaacacacatatacattacgtggatgaatttagattagaacattagcacaatttttgagtggctggtaataattcagattgatatatgcaatagcaataccgaggcatcgcttacatatattctgttagaaacacttgtctttttttttctttcctaaggtaaagtcaaaattagagcaagcaacaaaaagaattaaactagaagtgggtaacatttttccccctagttaataaaagaagtaataaactctataaagtactagagttaggatcactaacactttaggtgtaacagctttttaccaggaatttacaactcctgttttaattcaagcagcttgcattaggacataaaatctaggtatattttaaaagtgtagttttatgtgaaataactgaagaaaaattgtcctttcctaaaaagtattctttcttcctcggtcttagcttgcctgcctctccctcatacacatatcttggcactcaagaatcaaagttaccaaatccctcttttatgacattgcaattttttggcaaggacaagcttctttccaattctgccacattcatttatttgaagcttgtgggagtcttatggcaagcacattatttctgagaaggctttaaaaaaagaaaaaaaatgcttcatggctaaaccttcactatggcatttaggcaaagaaggtatcccttcctcttagtacaaccacgaatgatcacttacagcaaaagagttgatagcagcctttcatctaagacaaaacggaacttacctgagttatacaagtgaatgttaacgtacatgtacagtcttaccaccctcttctgggtagaaaccagcccatgttttttaaaaagaaaagatgggctacaaaaatgagcatctcaaataaatggttaaatataagaaagattcacaccaataaagtctgtgagaaggtcagatagattctgagggaggtggaaatcaggaagaccctttcaaagtggtctcttcatgaaaaataccaccggtgcactcagtatgtgcattctgctcagatattttggcctgaattttcaagataatgctggcaagaacagtagattgttcctttataaggaaggtaaaaataagagttatatagaagcattgtatttgtgcaacagaggttataatgccacaagagacttaatgttaactctcatcaatagaaatttgtaaaaatctctttgcatcatgaaaaggaaatcattcgtcagccatgaagctttgtggtctatttggtgcacagttctgaagacggtggaaatgagtggtgcagttcttgtagtggaggagtgaaaggtcagcagaggcttaaacgagcttgtcttgcatccagctgggccagcaggaggtcattaggaagatccgaggctcactttaggcttgacagagtctctccccatgatacaaggagaccgttttgctcattgctcttctcccagtatctaaaaagaaccccagggacaggaatgacactgaagtttatcttactaccaaagttttgcttgaggagggcacaactagcaattactcaggagggggatgtattttgtgtgtttgcttctgatggaaagtaatggaagataagtacaaaaggtctattgatcttgctctattgtgaaaccaaatagagtagcagggaaaaaaaaaaaactcttccttaacatttagaagtcagaggacctgcacaacttcatgttgtaagagaattttagaaatggagacttgtagtttgattggcaatgaaatgaaacagctaatgctttaaaatgttctcctcttttacttggaggggattaccacatcgtatttgacagctaattatattagggcaaatatactaatagttatcttgaattggtgctaagtggctcatttcttagaggtattgcctggtgaaatcatgtgtatttactgaaaagccctccctagaaaaagttctgtataagtttccaaacatagagaatgatggaaaaaatggttgttgctatgctgagaaggtggtaacaggaggcaggtaacatgttttcgcatcttcacctctgtcgttaatgtatgcagtggctcatcagaggtagctcatgttaatttattcctgcacacctgtacagggctggaagtcaggtaatcagacaagctaatactatacatttctgctttttagctaccgctaacccagaggcctacaaaggaacaaatttagttctggagacatcagcaggttttaatacatcaaatacacatgtcttccgccataggaatacagaactttccacatttagatgtggactgatcaaactagcaatcgaatggaaggttcacacttgacaccaatggttacctcatatttatttataaatcaccctcagcaaatataatttggtctttaaatttattcatatggctaaatcatctttctacaacttgaagatcaagcatatatgcttacctttcagatgaaatttaagacaaaccttgacaactactggccactactctgagaagaagaaaggaacaaagatagtaaaactcatgtaggatgaaaaagagacaatgacttcttactatacagatcatctagtttctgagtacaaagtcttcattttagatggaattttagaactgccaatcattaagacaaatataaatagattttaacatatgagccaatgataagaaatattaggaaacagaacagagggtatttgttatttttcttcctgaataaaaaccaaatgcaacttataaataggcttcccttcaaaatgggtgacctatgccactcagctcctggggatcaaaaatcaagtcagagtatgagaaatgatgaaaggtaaattacacccaccagctaattctgactatcacgctctcttcaagagaatctcccgtatgaagacagcaggttccaggccggttagaatttcctcttcctaggaaagatttcatatgtatacttcataatggaggggcagcctcctgttccttaacagaacagcacctcagcagcagacagatcaagggataaacaagaaggaggaaagggtctttagagactttcaaaatctaacactacaccttgctatcaggatatacttgaagacttcagcagtcaccttagagcagcagtccccaacctttttggcaccagggaccactttcatggaagacaatttttccacagatgtgagtagggggtatagttttgggatgattcaatgattcaggcacgttacatttatcattagattctcataaggagtacgcagcctagatccctcacatgcacatttcacaatagggtttgcactcctgtgagaatctaatgccaccactgacaggaggtggagctcaggcagtaatgctcacccacccaccactcacctcctgctgtgcagcctggttcctaacaggccatggaccagtactagtctgcagccccggggttggggacccctgctttagagcatcagagttctttacagagaaaattctttacatttcacttctatcactcagaataaaaattattctaacagctacctagtaacaaagatgaatcagattttgtgtgtattagcttgctctttgtcagtgtggaatggtcctcttggcttctgaatttgttaaacacacactcatttacaactatatagaaaagaatagctttgacactgttgcttggaatcttcagccctaacaaatcttgcatgtgtctctccccttcctctgtgtcactttacacaaagagcattcttgcttttgaaaaatcttcaacttgatcttataaaatctagaaggaccataaacaaagacctggaaatctttgctaattaactgccaaacctaaaagacactatttaacatctttctgctttccatcttactaacatgcctatctggagaccaaaaatgcaactacctcatgtataaccactttgggagaagcccaggcagacctgtgtaaaactcctccaaggtgttcgaatcatgaagaagtctgctttcgtaaacagaaggaagagggcaattctgttagctttatgacaggaatcctagaaaccctatagccctgcacacttcagcccccactcaaaatcccctctaatgctttatttgcacaaggaagacattgtggagtcaaggatggatgaaactgagactctggggagaggaaagaaatgggcctgaggacagcaggattaaagacaaaggagggtttctgtttgagaaggtctgttggctcaagaaaaaggtaagaaaacttgtcttagcttcacagcaaattaaaagggaaaaaccaaggagataaaattcctggggttctcgtgactaacaaagtaaaagtgaagagacaggagaaggtaagtctaagagacagatcagagatgtaatccaagaggctttgtgaataatgagattaaatcacaggttgacattcattgacaaaataacaataaaaggctaaaacaggaatacaattatgtttcacagttcactctgctgagctgcaggaagaggcaggcaccccaatggcatcactggttatttggtgtagctaaactcataacattatattaattcaagtcatagactcaaccaagatgaacacttttcttaagaaaatataatgtcaaaattaaagtatcagaacttgtgtgtttctaacctaagatcaaaagagttgcatattgttaaaaagcaaaatttcaagtgagaataaaaaaagtttttattctacaatgtttgcaatttgctttttcatttatcttatgtgacaaagctccaaaatgaaaaagactgggcatactgtgatttcagccaaatgaaatgtatcaactgtcttctgaagcttgctatcttctatgtgactgaacaccctgggagcacatctgtactcttcttcccacctagaatatcctcgtcatcctagacgcgggtctaaacgtatatatggctagtcactcactaaaatcctgatacctacaataaaaatgaagactgaaatattttcctgctatcaataaatgtttttcctcagataaaccaacaagcagtacctcaacagtgcctccctatgtgttaagacataaatatacaagcgcttgcgttttctaggaattttacataaatgaaggcttcaaacactgggtgtgtagccttttggtctcacagctatttattccagtgctgtgacttgcaatattttcagcaaaccaactaaaactgtgacaggaattcatgcaattaagcttaaattttggcttgtcttcaaacactccatttccataaatattttatgcaggttttcatgagtcttttatttttgtttaaaaaaatacaatgcattaacctcgttattagtagtgtactatctcaaatttaaaagaatgaatattactgacaacttggaggaggttgggtacagtattttattattcaaaatatagctatcttatctgatgcattctgggactgtcaatgataacttggaactgaaataacgttgtgactataaaccatgtttacagaacaaagtaaatgggggtgggaaaatcattaaaaaaatggtttctcctcaaaccatgttttgggttgtataagaaagttacttatttttcttaaatattttgcttttcaaagattggcccccttttatttcagtagaaaggaaaaaaatattcttcaaacttttattttaaaaaggattgatctccaaatatgaagacaaaactgaatattccagggacaggacactacttttcagtggtacttttaatgttactttgccaaagaactctacacaattgacaagcactagaattactgcttactattggtggctctgtagaaactttctagttaattttaatgtgtttcttccattgatttccaccatgttataaaattttctctaaaatatttttagaagacaatgtagaaccaaaaaccgcatctgatataatgggaataactaactgctgtgtgacccgagttgggctggtggtgtattatgtacgtgatctgctcacaagcttatctgaacaaatgcaggataaccgcactatcctgccactgaccaccttgacacattccatttatactgcattttcttgaggattaataaagaaccttgtaggtttaggaccatctgcttctgcttaagcccaactgtttcagagctgcaactacatagcaagagtgtgatgtcatctgaaggctggacataatatattcgtgctgatcctcaaagtatatgcatgcctccccttctgtgcataatccgcatggtagactatagtttagagatgtgctcaaagacattatgaagttaagataaagaaacccacacgaccataccattttcccacatcaacaattacatctatcccatttccttctgatattttcacaactcttaaagaattcaaggacacactaaatactcatgtaaggaatgataacattactggttatacctacggagatgcaggctgtctcgatgtcctggacctatggttctttccatccgtaaatttctgtttctatattggataaatatgtgtgtatgaagataatatactgatttaattaaaaagccacatggcaaagcagaaatataaatatataaatatatatataacagaagctgtggcttctaagtgaaggttcacggggaagcagggaaccgtgtacatagttaacttattcacacctagatgcatgaaaacacatacacacacgtatacacagagcacagagaaaaatggcgtgcattacgggtaagatggcacatgattctgcatgcttaatcatcacaagcaccaactgcaacaatccttcatgagcatggcagcctagttatcacatgatcactgtggacaatctttacagtgcaccaaaaacatctaagttggatttcttttagtgtgaagtccaacatgactgaaaactggcaccctccacccccagcaggagcagccaatggagatttactgacctgtctcggcttcggcgagaggggaatgcagcattgcaaccagccactgtgcagacgtgcatctctttcaagtgaacgttcctgtagtgaagtttcacactgtaggagcttttgaaactcttcttgcacacataacagattttggggtctgggctagaacataggtcaccttctggggagaacttttgagggctgccataattcagagacgatgtaaagctctcatgcaaggcggccatgctggcacccccaccattgtacagtccatactggctcatgtaaaacatgtcgtaagtggggtctgtaaattcttccttcaccttgatgacgtcctggtgagagggctcactgtggttctcatcaggcctctcactattcatcaggactttttcactcacttcgctgtgaatgtgctcatccccttccatggattcctcgcccagtttgggctccgaagactcagactcgttctcatagtcccgctcaggttcttggtcttcagaagtcatgctgtcggccctccttatttcagtccttgaaatgcaccgggtcctgttatgcttagaaaagtccttcacagacatgcctgggctcatctcctcttgggagtgacaatgattgtcatggctcatgtcattgaccacagctccaccatcattggggtcatcatcttcatcatcaaactcatcggcggtatcaataatttccttctcaatcttcacaggcatgcttgacttcctgggctttttcttgggtgccaggtcagcactgggctcatgggtggccatcatcactgctggcactactggctcagagggtggcggggggtgctgctctatggtaccactggttggaatgatgggactggttgggagggaggttggaggactcaccatttcccctggagtgagtaaacttctataaaatggaggaactggttgtacagtctttagcccagaaaatactagctggctagggagaggattttgcaagacagggtctagagggggagtggtaaaacccattgggggtcggccagggcttgtgagtgccagatttgattttgtacttgctatgacaggggtggcagctcctgaggtggcccgaattaaatctttatctcggttattccttagcataggcatgtgaaggcgaggattggggtttgcactgtggcgattacgacttcggagggagctaaagaccatgttgcaaccttcaatggtgcatcgatgtttgatcttcaggtgaacagcattgtaatgaattttgagagtacctttgtcatagaatgtcttcccacatgcattacagaacactcttcctttcctagaggctgaccccatccttctcatccgatgaatccggaatgagctttttgggtgttcagttttggttagatcactgactggggcagaattctgaatgggagagacacaggctggctcggttttgggctccacattagtaatgctggtcagggcatttctattgggtgtttgatcattcttataaggtgtgggagaaacttcggattcgctgctctcattatattcattctgagttgaaaggctgggttcccgcagcctcaaccctggttgctctaacagtagcccatttggaggcaaccctagcagtggtgctgagacagggtttatgtactggaatggaagcagaaatgcaaggctgtttgggatgttttcgaagtgatgaatgctggaaggattgctgttctctaagtgagcaaggaggctgggactcctggtgcgattattgctctcaatgaaagtccttatatctgagtctgtctttgaagatggtacagccacggcctgcccttctttctcctgaattgccatcagctccacaatggatttggtttctccaaaccgcagaaactgctgaagggtgatgatttcctcttctcgagacatgatggcccagcggtccagcaccttgccagcagcatcctagaggccacatcaaagaaacaacaaagacaaacacaaaaacttattgattgtgcataattattcaatgcaactgaaggtgctctgtgtgctcataaaacactgagcaagagcagaaaacaacatgcaagcactgttaataaaagtcaacccacaaagcaaacttttctgccatgcaaatgtagtaattagagtcacagttagagaaacagattgagtttaataatgtcaaagcaaacaaaatgtagaccactggggctctgtgatctaaaatgccttcagtactgcttttttaacaacaatgatctatatactatgcaactatttagcatatattagtataagatgtgaactcttgctgtgaaatccaatataaatgaaaaaaatggtaccttagtccttattaaatagtgatactataggaaggaattaagtacttcttgtgaaatttacttcttcaacataagcagacatgacactggattcaatgatgaaaattcctttaaataggagttatgtgaatttctgaatcaaaaagatgaataaagtagcactacccctcataccttgttactaaactgtatcttttttttttgagtggctatattttagtatcatttaatagcaggcaatttcataaggaagagtaagaaaaacatcactcataaaaggtaattgtacttttcctgaaaattggttgtaatcctatgattcaaagtttgagttagacttaatgtatttgactttttatgatcttgttataaatgacagtcatagatatttaaaaagtaaacatgtgatggatttagacagaataaatgtgtaaaaagttgtctctcagcatcctcctctgatagcaaagggagtccacagagaatacacatcagtaatcaccagactatgtgttgttaaatatacattaaaaagcatttcacactttcatttttgccagtaactatgagatttgcctggaggtaggactttaaaatcctgcaatgtaatgtcaggcgatccatttcagcatggattgagagagatctattcaaacacttaaataatgactccatcactttctagggcaccatttcttcccattgggacagcacactttgtatccctctgtgagtgacacttgccctaaccctgaccatgaatttaagaaagcaaagaatcttcttaaaaacaaaatgacaagatacttattaattacaaagggaaaatcataacattatcgcaaaaaacctaacagaccctaccttaaaagggtgatcgacgttaccaccgtgagtagaaatcacgccatcatgttccgcttgttaggacacactaagaagggcacgacatcacttttgtggcattcttctaatgatatggtttggctgtgtccccacccaaatctcatcttgaattgtagctcccataatccccaaatgtcatgggagggagccggtggaagttagttgaatcatgggggtgagtctttcccgtactgttcctatgacagtgagtaagtctcatgagatctgatggtttataaaggggaattcccctgcgcatgctcttgcctgcttccatgtaagatgtgactttgctcctcctttgccttctgccatgattgtggggcctccccggccatgtggaattatgagtccattaaaactctttcctttataaattacccagtcttgggtatgtctttattagtacatgggaatggacaaacacattgtaaaaattttacaacctcaactcaatcatcagaaatcatcaggcaaaccaaaattgaggggcattctacaaaacagtagatagtactcttcaaagtgtaaagttcaggaaagatttataaaaaatgaagaatggttccagattagaggggactaataaaaaataattgtgtgatcctagaccagaaaaaagacattagtgggaaaattagcaacatttgaataaagtctctagattagctagtagtagtatacccatctgaattttccggtttcagccactgtgctttatgtaggatgttacactaggggaagcatgatgagaggcataagggatctgtactgcttttgcaagggaaaagtctctcctcaacctgtggatgtaaaattctctctgaaacactgccctatggtctgaatcatcacagctagtttgattaagtgggtatttggcatttacttgaattacttttttaaaaaagctctgatagttatgtgcccccctttgtaaggctcactcctagcatcctaccattttacataaagaatatgtgtgagtacgtgcatgtgggtgtccattcctatgaaaactgtcaaacacagatgtccctccttcatcatgtagatagaattggccttcagatcaaatactcttatacaactatctgctcagaagagtcacataagggtgcaggcacatggcaaccccagatgatcctgaagtccggccatcgccattttcaaaacctcactcacagcagttggtatcattcacattctgcttttggaacaggggtaacatggaagaatgttggtgctataggtaaatagagaaataagttgtgactttaaatacattatctcatttcacccctatcgtaacttccagagctcagagaacagatgagaaatcaggggagaagaaagctaagataggttgttaaggctgtcaagatactaattgaaggcccaggagttgaacacaaaaattctgactctaagtttagagtgtgtccacagtactcagtggctgtcattccatgatgccattccccaggtaagcccattgagtctgtggtagtaaagagcaggacttctgaggaagtctttctctagagtgctataatgtcctcttctataccatctttcttgtaccatcaaatctactctcttgagtgttcttttacagagcctttcactacggattaatttctcaggctgagcctcaatctgagcaatgtacagtcatatcttccccaggttcttccaaggtagcctgtacctaaatctacatgtcagtgatatacttatacaactggcagcctctggcattaaaatgcacctcagaaaccataggaactgatcagtcccacctgaggcatctcatttccatcaccctttatcttctttctccctacagtacagagcagtcccatatggtttctcctggcccaccacaatgcccactactatttctaaaaccactgcttttcagattgtcttctagcgcttagttgctgtctctgctaaaatggagtctgttacattaaaccacttgcttctggtgaaagagatccaggtaagtatgatttagaactttgctagttcctgaatcataaaagagaagctttatttatagtggtaatagaagcagcaatttatatttacacagataaacaacaaagcatatttgcaaacaaatagacttaagaacgggacacatagctctataacaccaaactagagtccccttgatagtgccataggtgtcctttccaaagaagtcatcattggctgcgcgttgtggctcatgcctataatcccgacatttaggaaggccaaggtggaagatggcttaagccctaggcaacatggcaagaccctgtctacaaaaattaaaaaactagccaagtgtggtggtccgtgcctatagtcctagctacttgggagtttgaggtggaaggactgcttgaatccaggaggttgaagctgcagtgagccatgatagtgccactgcactccagcctgagcaacagagcaagactgtctcaaaaaccaaaaaatcattatcaatttgatcaagattatctaattcaccacatttataaatggagagactgcaacaagaaacaaattgatcttacacaacctaacaagtgtgcaagctggatgctaagaatggctagcagttttactgtatctttgactaacctcgttgaagggagttagaaagcatcaaagggaaaaaagaaatgccaagtttttttctgaagatctttgtgatagaaataagtatggtttggtgctttgattctgaatcactagtttaagagtcttctgtgaaggtaacgacctctatgcatggtctatattgctattcaaaaatggaccaatgtcagttggatggctcttttctttttttaactcatctggaacaaaagtaaccatttggaaaatttgggacaagtggacactgctgcaacaactaaaggcatgatacatttttttagtcaatttatttttattgtatttaacttaagtattggaaaaactagtcctccttgcaaacagtataaattgtcaaataaactttacaaaagtaaattggagctataaaaagaattaggtattatcgtggaataaacactaataaaacaaaaattcagtctgttaggctaggacgaagatcccaactaccgaccaactcatgctgggccactggtcttatgcatgaataatatgttaacatcagagtacataactgaactcttggccctccctgcaattttgtagctggtaagtcaattcttttaggttttcccatttgtaaccagagtacagtgacttttaacccttcaggttgaaaaatgttattgacaaaatgaggataataagatttaccctgttaagttaaatgcgagttattatcataagtgttgatttcctgtgaaaataactggctatactgttaattaaaagatgagtaacaccaaataatatagacttataaaccagttttactgggttcagaaaaagtataaaagacttaaaatatttacacctacacatttgaaataaaaagacttccttttgttacttcattggaactggtgattatcacttgtagaaatctggcaccctgttcctgtatggctctgccaagtgactttttaaaactttttgttgtaggatcaaatgcatggtttaaatggttttatctgagtcctttcccacatcaaagcacttcaatgatttatagttttaaaatcaaagtaaaataaggttgattggtttcccttattgggaaagagggatagtagggaaggaacagatgtgaagagatggaagagaaaccaaataaggggctttgggataatcagactgtcgagggacctcaagctcagtccaacaaggagcccacctgtgttcatggcaggctacaactcacatcacagcatacaggaaaacaactgctttctttctgtccaagaatggaagtgaggaagaaacactggacgcagcacggatctaaggcctatgtgctccagtagtcaaattgttaagaaataagcagccgggcacggtgactcatgcctgtaatcccagcagtttgggaggcagaggcaggcggatcacctggggtcaggaattcaagaccagcctggccaacaccatgaaaacccgtctctactaaaaatacaaaaaaattagccaggtgtggcagagggcacctctaaccccagctactcgggaggctgaggcatgagaatcacttgaacccaggaagtgaaggttgcagagtgagactctgtcaaaaaaaaaaaaaaaaaaaagcaaaacaagaagcaaacagtttaaaagactcaatcatatgaacttattttcagtcaagtttaaggtataatttaatggaaaatactaaaatgattagctaaaaactaaaagtatttcccccttgatataactgtagagcttttaattaaatgacactgacctgtagggactgctgactacctaaaacaaaatcagaggtttgtgagatatgtttattttttcatgtctagattggcacagtgtgctatcttaagaaattatttcatcataaccacattggcaatttattttcataatcagtttcctattgtacttttctattctttttccttctgggttaattcaaatatcaaagcaagagaaacagattggatagaaagtagagaaattaccaaatttcaagcctacctagcttaagtattccattaggtaaaatgaaacagtaattgctgaattaaaaattgatgaaacaatgctatgcaaaacttaaatcataaattttaccaggttttctagatgttcaagtcttaggggtaaagaaattgtgagatatctatacaatggaatagtactgcacaataaaaagaactaagctaccgactacaacatggacgactcttcaaaagcattatgctaagaatgaaagacgttagacccaaagacatacatacgctactgttccaagcatatgaaattctggaaaaggtaagattatgggaacataaagtggattagtagttgccaggggaaagggactgagtgtaaagcaacactagggaacttttggggtggtgagaatgttgtacaccatgattgtgctgaggtttttatggccacatagattgtacacttaaaattggcggattttattgtatggaaagtatacttcaatgaagttaattcaaaaaattaaatcacgcaaattgcttgaactctcacacacataactcaacatgtacagctttccactgtttataagccaccttactcctttcctcctgtattacagcacggccaaatcacaggcacacatgctcccatttgctcctattagtggaatatgcaagacaatccactgtgacatggtgagtcaacatgaaaactcctatttatttttacctaaaggtgattttttgctagtatcattcatacacacacacacacagagtttagaaacagctttacatatatataaatgggggtacatgctcacaaatttttactaatggggtgtgtaatcataaaactatggagactacctccctacagagctaacaccaatatatagcaggtatgtgctatgcacacacaccttcgcagacactctgcaagacactgataatccgcctttgcttgcctacacctgccggtgtgctgacctcttggttaggtggacatgtatcagaatgtgacccagaaattaggagatataccatctaacttctggatcacctcaggagtgagtgataggctcagaccattatctcaggtaatatgaacaggggcattcaacaaacttctagctaggggtcagcaaatggaaaactcctagatcccacatgtgggttggaaagaggtggctctgagtgctgaaagcaggagtttcagggagatattctgtggaagagaaacctttgagcattacaaacagttctgaagaaaacacttatacataatatgtgcagtcctcttctctctcattctcccgctatttacctgttttgtaactgagatgggtccatatgtaataagcagatatttcaaccttaaattgtcattctaaagccagtatttaaaccctcagtcaaaaagtttaactgatctgactgctccctactatttcagagtcattttttcccttttttgttagattatgtttatctctctaatttataagacttggctttccaaagtgtgcatggatcaatgttgtgtgtctatgtgcctgcaagtgtgtaagtatgagcaggcaagatggggagaagaataaaaatggccacacaaaaaaaattctcattgaaaacaatagattctgggaagcatttagggaaatttttcaagcaatgttttgataatttctgagaaacacttaaaatcgtggaaaaagaacttggcatgtttatttgttttagcagatttacattaaacacatatttcttgctgggcactgacggaggaagatgcaccgctagcatacacaatatacatcagagcactttgcttgtgtaagtaaacaaaattacaccattctctattcacacaaagctcttttatgtgactgtgcttttccagaacttcgggctaatgtttctaggaggccagctggaacaactgtaatatttgtaggcagaatgaaacatactcattcatatcacggttgtatgtaccaaatggttcaaattagaacttttttttttttaaatcaacatttgttttgggtaacgaaagccctactcaattttcatgatttggaaatttgtattttgcagaatttctcaacagcatccctttaccttcaaaatacaatgctgaccaatcacatccctactctcctctctaggacagggatgccccatgagtgagagtcttcagggtgtggcatgggcagaaagaatgatttcgaaataaaaattcagactggactttacttgttaacattgacctatgtgaacaaatatgctttcctcatccaccccaaactgcctttgtcatgaagtaagtatgcaaacattagagataggtgtataccagcttgctgtgattacacagctaatgctacattcagttcatccagataataaaggacttaatttgaaatatctttcctattcttcctctgcccaaggggaaatgaatgctacaggaatatccaccattagttagaatgttggggctctcagaaaactttgtattaaagaagttcccatcaagataaataacttattagtctttgttagctgacatgctaacattaacattaaatcttctttctgtaaacactgactgcatataaagattgatactttaaaggagttactcattacacacatgtgcatgtacacaaacacacacaggaatacagaaactactgaccttggctcactcttattatatactactctcattataaatcactcttattatagcattcaaagtgcttcaacttagcgaatggtgatataatgaggtgaggtatatcaaactactagcaaaaaaaaagtacatagtcaaaagaatgcctctccttggattaaagtggaagtttgaggagcatggcccttgactctagtttttagaaggaagaagcaacatgataattttatgtgactttgaagtagtggctttgatatatttcccagtatacaaatatttataatttttttctgatccatatttgaaaaaaatttcacaatggaaaggatatatttttaaaagaagtaatgtattcacaagttgaacaatatactctccaaaaatgatcacctctctaaccaaaataacattatcaaaatgccagggcactagtttcatgtggttcttctgatttttaaaatattgcttgacatttgatttaaaaaatttactgttacagaatgttcttgattacggaccagataagaatgtataattcatagagtactatgccttttttcttcagtaacagtctatacagcgtttttattttaaaaacagtgattatgatagatcactctggggtacaacatatttaatcatagaagctccagctaagctctattacaggcctgtcaggatttcttccttgtactgaggaattttagcttgtctagcttaaaaccagccatatgcatttcctctatgggcatttgtttgcaaataaataaagcaggtgccttgctttgccatattaaaaaaattcaaaggagtaaattactttctgcaatgtctggaattggacttcaaagattccaaagtatttttcaagttacctcgctgcattgtaaatcaaacctgagaaacttttaaagacacattttaatatttaataagaatatcttaggaatcatttaagtttcaaaatagaaaatactaaatccagttgatattcctagtataccaatctttaaaatcaaattacctatgagtccttaacttaagcacagaatatctagccctatacctttaggctaaagcagattttgtatcttgattaggctaaatataacatacacaaattcaacctcagaggaaaataaaattaatgttcacatgtaaagaggagtcatactaaaatttgtaagccttactaaaaactcagctttacaattctattattctactatttatgcctagaatctgaacatatgaatcactttaattaaaatgttaaaacccttttacttttaaccaacttgtgtaaccaacgtatttttagaatatgtgtatttatgactgaaagtatgcctttatctgaaagttcctgtattatcgtatattctggatgtttcccctgatgtttctgtctggtgctgcttgtcagtgatgtgattacagtcactaattcttttggattaattttgactcctggtcaattcaatcatcaatcagttcaagtaaaaattctgcttgtaaactaaggaaactgcccaaagactccctaagaggccttggaaacccccaaatcataccagtagggtttgtgaacattctgcaacttgaaggtacaaaataaatgttatatatcaaaaaaactatgtaaacaaatatcggtagtctttcggaaatctttgcagctccaaaaactagcagtatttgtacagaagaccctcacctcaattaaaccctttaatagttcttcatatggagatgataactagtggagattctagagggtacttattttatagtttagaacagcaaaggaaccgtttatgatccttaaggaaaacactagaaacaggaggaaagaaagggacagtccctgcagcggccttgttttcttgtccactcagacataaagataaatccctggtcttaggacagctataaatctgcttgctttacaataaacagaactcaccagagccctctctgacatttttgctttgaggtctacattttctagcttacctctccttgcataaaccaaagttccactactaaatttgtagatagttgaggctttacatttctaaacataaatgccagagtccctgggatttccagatatgcttttccacaatgtctgaaaaacagcaaaaataggcgcaaaaaatttttttacatgatgatggtgattttacacatcaagtaagggccaaaacttgaacaattcaaggctacaacctcttatctttgaggttccataaggttccatctgcacaatcaagattactgatattggtatagaacttccaaagcttgaatggatgattctccttcacatattatactttgaattactttacaaatgaagctgattgaacaaccccaaggaactttaacatattcattaggatgtgagggagcagggcgagaaagggatggaatacttagtaagcagtattccataaaacagtgaggattgagtattccataaaacacactgaggactgagtgtgtgactgaacagaaagatgtattaggagatttaactttgttcttttctgggtataagaatagccgtagaacacaaagattaatttcctgctttagcattcatcagggaacaacacattattacttgtaacacatacacaaggctgttaatggatctactttcctttgattgctcagattaaatgtgttcctataaaaggcacccacacatacacatgtgtgtataattataaatccacatatgcattaatagtttgtgtttctgtatattaataagccactatcaacgtagagattatatattttattgggccacaaaagagaggtgtttggggtttggtggctgactgaagaaatatagatcaaatacagaataatcagagtaaacaatcaatatatgttactataacaaaacctcagaaattcaaaatgaaaaaggataaaaggagaaagcgtacattatagagcacaaggtaataacggcgtctgcgtgccttaataccctcttgtcccagcagtcctgactttctaagcagcccacttctccacattaacggtagtcatttggagagctgcaaacgtgccattagaagcacttttacaagtgtatattcatccaccaattagcttaatgtggccgctttctgcatattttctatccaggcttgcacaaatcttattaatatttccccctagcgctttgacagattaccttgtcattatgcatcctggagccttttaaacaatatgggtaaactactgtttgtgaggttaatgacaattatcccctaattactgcataagtcactcagtccactttatctcataggcagggttctgctctgtgtatctgccattgtgtcaccgtaaatgaatcttgtattgctatgtttatctgccattgccttgtaaattatactgacagaagaatgaacaaattactgcatgtcatcacttaaatactacttctgaaataaaaataaaaaggctttggcacagagcttaaattttagcggatcacaattagtaaaaacatatttaatgttctatgttgcatttcagagctgatagcttggaatttagtagtggaatcacaacaatggaaatgggggtgaatgggaggtgaaaagcaatgggaataaaagttaaaggtggggcggggggggagggtaactaaaattgtaatgccaatatgatgacctgaatacatttcctattattttgatagctgatatggcattctggaagtattttccaaggttcatcaattttaaatcaaattaaacgggttaggtataagccacactcttcagctggcatcattttttttcagtgacttataactagtccagacataaaacacagaatctttgtaattgagaacagataatgtaataaaggccacaggctaagccaatttcattgatgcatttttaaacattattaaacaggttcagaaacaatgtttccaaagttgcatttgaaattgtttaacaatgtttacatcagtgaaattagtttaggccactgctgcatcacagtgaccacatctgctctgataaaatttacagggaaaattaggacaaaatgagcatctttaaataataatttaaaaaagacagactgcatcaactgcagataatttagaagaatttgtttttaatctgaaatctatgattctgcagattatcaggtaaataaatgtttgtgtgagaacaggaagaaacatctggcattctgagatgactgccatttattatcttaaaacattttcagatgtaaaatattcaaaatgcttccactatatgacaccaaggtggctgataactggcaagcataagtaacagggccacaccaatctgaaggatagctttcaactctcaattaattgggcatgcagaaagcttaaatcaaatcgccttatgacagccacaggtttgtacagagaggcttctaacaccgatgataaagctgtttggtagaaacatgcatgtacaccatacagtaactcttggtgcacttgctgaacaggctggaagaaacagctgcagcaaaaggaaagggaaacatgaaagccagagttgacaggccttgcccagggagtctaagcacaacccctcgggttctgatccccagagagtaatctcagtgtctgtcctgcatgaaagcaatgcaacttcaactgagcaggtgctgcagggaaaaatggaagtgccatactcttttcttttagtctttgcagttaaggggactgagatgccagttaagacagacatcactgtgacaaccactaaggggttaaaatctttcctgatttatttaactatctaggctatctatggatgtacagctgagtaaagtgaatttctaaatcattaactttatcttttaaggctggatttcgttgcctttttaccttttgctaatgatatatctactttgcagcctggggaaaataatgtgtgtttaggggagacaattaagagagataaactcatggtgccacctcaaagaaggtaagcaccaacaggattttactgagttggtgaaatcggtgctggttacagaaatgggggcaatcctggaaggatcaatataaatgccaaaaggtacctgggtataagttaacagatgaagatagccattaaaaaaatagcaggatttccctactcactttaatccactttctacacactttcatcaaatttcaaaaacatgaggttgggaatatttcactccccttcttagcaaacctttcatggctccctattgtacacagaataaataataaatcctcttacctggcatctgaagtcccctcaatatagactcaacctacatttctaacatcatctcctgccaagacctctgaagctccagctacaaagacctacttgccataaatgatcctgaacactacaaaatctcacctacctctgcacccctctgcctttctggtatgcccattttcatacttcaaagcccaactgaaattaacctctccatgaaatgtttcctctcctatctttttccttccaccttcccactcccattaaaaatgacctgccccttcagtgatctgcttatatttcagggatctgcttatatttctctgtcaagtaggtctctttatttcaggtttatcgtccttgatatccccactgccaagaagactcaatgctcacagagtttataaatgctatgaatgtaggacttgggaggcagcttagaaatcatctagtgccatgttttgtctttacatagaaggaaattaacaagtaagtatcttgctcaagatcaggaggctaaagtgtaagtagctgacttgggacaagaatctagctgacctgacctggtcgagtgcttttcctaaaaatgtaaactagttccccaggaccaatggtgcagggaggcagcatcattactagtacgctaggggtgaagaacaagttaagaatgacagtttttgcaaaatgcatacattttaaaatttaatcttcattgttttttcccctgcaagtaccagtaagttacctattcttagaaaatgcttttgggaatgagattacctttatgtggtacattttcttgatcaaaggtaaatcccagtgtacaaaaaatcagcaaactgcaacactgtctctcatatagttggcagttctgtaaaggcttatggagtgaataaatgaattaaatgagccagtttaatattagacacataaataatgaaccattacaattattattattattattttttagacagtctttctctgtcgcccaggctggaatgcagtggcacgatattggctcactgcaacctccgcctcccaggttaatgcaattctcccaagtagctgggattatagacgcctgctgccatgcccggctaatttttgtatattcagtagagacggggtttcaccatgttgaccaggctggtcttgaacttctgacctcaggtgatccacccgcctcggcctcccaaaatgctgggatcacaggtgtgagccaccacgcctggcagaaccattacaattataaatgttcgtgggcgcatactttcttccttcatcttatcttctgcaaataactttttacattgattaattcctgaattctcttctggtcttcccctccttcctgcaatttctaatttctgttctgcatctgttcaatctattttataaggaaaacttcaactctaaggatgtctttagggatctggcctacagatcaatgtaatcagttgctcaaaaagaacttctatctgaattctgaaaacaaaacaaaactaaacccaaacctagaacacataaaggcacagaggctactggacggatttaaacaatgcagtctgtgccttggtctcctcacatatgaaatgggattaaaagtaactatctggtagagcaaagaaaatgaaagaaaaatactagtacctacactttgctgaggcctgaaaatgagccaagtaggatgctaggtaatagatatgtattctgttcatctatacccaaatcaggcttgagatactattatcaaacccacttaagagatgggaaaactgaggtgcgtcaaagttgtctaatatcatgaagtgagtaattttcgaagccatgattcaaagaagcagtttgagttgagccctccactgagatgctcttcacagaaggcactcctgcctgctcacacccatccaaaccccatcaatgtcctctcctactttatttcccactattcttctgaaatccaggcctgaagagttaagagagtttcatatacctatctctttatacctattctcccaagcttagtaatggctcacattacatcctaactggattattttgataggtgctcattgtttccattcactcctttcaccccactcacattctgacgacattctggtgtcaaggtgctttttctaaagtgcacctctgaccacattacaactcctccctttaaaataaacctcagccgggcccagtgtctcatgcctgtaagttccagctacttccatattcagctgaggcaggagaactgcttgaaccccagaggcagaggttgcagtgagctgagatcatgccactttcccgagtgacagagtagactccatcttaaacaaaacaaaacaaacaaaacctcaacggtcccatttgctaaatgatttaagcataaattctttaatgctgccattcaagaactgccccaatctaccttttatgtcttagttctcacatacacactctgacactgcaccagaactagagaacttagctttcagtgaacacactatatactcccaccaccaacgttttgcttatgctacctcttctacttagaattctgtcatcagtctgctggggaatcatttgtggcccacctatcaaatgttatctctctctcttgaattctgtgatctgttcagaagtcccattctgcttttttttgtgtttttttaatcacattctattttatatctatgtgccacatgtaatctcagataatcccttacagtataaccagctgagtacagagtctgtaaaatacacatctttctacccctagagcagagcttggatggtactaaaaccatcacatttataatacaattattattttttaattttagagagagggtctcactctgttgcccaggctggagtgcagtggtgtgatcatagctcacttcagcctgactccttggctcaagcgatactcttggctcagcctctcaagtagctaggactacaggcatgtgccaccacacccagctaattttttattttagttgtacagagatgggatctcattatgttgcctaggctggtcttgaactcctgagttcaagtaatcctcctgcctcagtctcccaaagtgctgggattacaggcgtgagccacacaacacaatttttatgaattatgctgttcttatacctaatttgtttctgttgaaaactaaccacttgttacttctgtaaactcaactaccttctttagcgacatccttactaaaaaataaaacaaacaaaaacagccagtgtgagcctaaaacctgtttttcaatgtctgattaggcagtcacatttgcaaatgtagatatccagaagttttacataatatactcagaaataagaatattaatattttctaatacaagtaaatattcatctttctgaaaatattttaagaccttggttgagcctatgattcttagttcatttgttacagaattgtttatagttttaagggcaaaaacttaaatttcctcaaatgtaaaaataaatggcaagagagaaaaagagtggctatctcagaaaaacaagttggaaagaaaaagaaatgcagggactagagactaagtatgagaaacggagccccaggtgcaaatgtgagaaatgaatatacatttaaaagctgatagactagaggcaatttccaattgtgggcaaaaactgaactgcccaatggtgaaactgaatattagcacatttaaaatactttaaccaaaacaatatgtagttgagtcctggccagagtttgagatatatcagcatctgcaggtggggcagagggagaagtggtagagagcatcttttacagaagacttggtaagactaaaatggccaagagaaaataaacacatagatacatgaaaggagagactaattaattttgaatatatccatttaattcttaatatggagctctgctcctataccaaaaagaaaatacacagagtggggggagtaggggaaagcacagaaataaaacaatgttaatgaatggatatgaaatgtattttaaaagaaatattggccgggcgtgatggttcacacctgtaatctcagcactttgggaggccaaggcaggtggatcacctgaggtcaggagtttaagaccagcctggccaacatggtgaaaccctgtctctactaataatacaaaaaattagtggggcatggtggcacatgcctgtaatcccagctactcaggaggctgaggcaggagaatcgcttgaacccaggagatggaggttgtagtgagccgagattgcaccattgcactccagcctgggagacaagagcaaaactccatctccaaaaaaaaaaaaatcatacaaggaacttcaggcagtctaaggtataaaatataaaaggctttcacttattttacttttcatacctagtagcatttgttatttccaaatctgtagctataatggttccatggaataaaaaagcttgccttattccaacttttataattagtgaattgcttctctctgtgaactacagtgcaatgaaagagctcaagccactgcttaggatcaacaggtagctgattttctaaatcaccaggaggactttgttcttactcatcatatctattagaggaagaaaaggtactattacatgacaactacctatcaaggacttaatgccagtttaacatgaaattaaggtcaaaatttcactaatgaaaagaaggtggaaaacatttcattttttacttgtaattacctaccaagtcaggaggcaacatttttgtcacctaatctttctttcagcatctgtttttatggagtctcaaatagacattgcctataaattcacatgttctatttgctctatgttcaattttctttggagtaaggcatgaaggttaccccactagatcaaaaaggcaaagtttatgtgaggtgaacacttgcagacaaaatcagagtcctgggaggctgaggcaggagaatggcatgaacccaggggatggagcttgcagtgagccgagatcacaccactgcattccagcctgggagacagagcaagactccgtctcaaaaaaaaaaaaaaaaaaaatcagagtcctaccaggccaagagcagcaggtaaagtcactggtggccagcagccactcctgcatccagtctctgtcctgtactttctccccaaatgctctggcagatatttcctagcagcacttctgcttctttcttgtcctgataaggaagcaactaaagagtccttgaaaatggagatagacatgaaaaactctagcaaattatctgtcggtagggtagggaaagacatattctagataaatatccaagaagtgggacagtggtggaatattgtaaaaaacatcaaaaaatttaactctaatttcaggtaatttttattttaatttgttaactcataaagaatttccatatgagggtcaactgtcactttatcagtaagaagaattctagttagtactggtttctaattattcaatagtagaaagcagggaaaatgtgtgagtatatgtggtggggagagagagagacaaagagaacgaacattgtgttatgtctctctcctttatccctcagttctaatggtagtggagaacaataaatgaatttgcagtaatatgtaaatatgcaagaagtgcctacctgattacattatattccaaaaatattcactgactaaactcaatgacaaaatgaagtagtccttaggaagaagatcatatggaacaaggggtgtcaatagaaaaaattttcaggcacaccttctgaatttctgacttttctcctcatatggaatcttatgtaagttagttttggggggactaacttacttagggacctgtgttgggggtccaggtccctaagatcagtcccaggattgcgagactcacaggactcagcacgtggtcatacgcacacctaagactcactacagtgatgggatacaaagcagcatcagcacagggcaacatgcatggagcaaactccaggggaaaccaagtgcacgcttccagtggtgctcccagaggagtcacataggatgcatgtaatttctccagcattaaattgtgacaacaggtgtgaggtgctgtctacaagggaagctcatttgcaactcagtgcccacagtttttgtgggagtggtcacgtaggcatgctttgcctagcatggaccaaaattccagattcccagaaggaaagcgcgtgttcggcataaagcatattatttacagtgtagaagcaatgagccactctttcatcaggtgaggaaatggtgggaatactcccaaaatccaagttcctggatgccagccaagggccaacctggcaagcaggcctccctaaagagggcagtctcaggcctgctaacccttttttccacaccttcccattgttgtttcagatgcactagtgtttcagatctgcatccccactgccatccaacataaagagagattctgtgatggtggctctaggtggccttaagctcagttctgttgctcgatccaggaatgggtgggtaggtgggagaaagaggtagaatgtctgtctttatttgagcacagagaggtgtgatttattagtgccctctacggtgtccagttaggttgagttaaaaaaaaataacattactgaaaacatagtcagtcctaagggggaaaacccctaccattataaactgtgcaataacagatacatgagattaaggctcatggaagccaagggaccatgctagcttcatttcctttagagagcagccatcaaatgagtatttaatatatcaaaagttatttattggaagatgcaactaatcatttcccaaaagaggctgctggtccattagaggctggaaaagcagcttttgtggtccttttcaacatttacttctaaaatttacttctaataacaaaaatcaatattgggatattaacaaatatcttggttttgattttgtattcaaatagggtagaaaatcttcattgttgtctgaaactgggttgtcaattcttggcctacaaatatgatataccctacttatttatagcaatctgctagagtcatgagataatttagggagaggaaaacaatgtaggtagcatttttaaaaaacaatccgccaactacatgtagaagtgtacaaaaaacatttcctacagccctatggcaagaacacactgaccttcagacttaactaatgggctatcataaatatgtattacagaaagggaggtgtgatatacatttggctccaatgaaaagtaacaactactgtttactaagcactcactatgtgccgggcaccaagggaacaagcacttcatatgcatttacctcacttaattactccatcactcagtgcacacatgaagccctgaaaccacatttcagctcaagtccagcacgaggagagaacaatgagcaaatacatgcaccgtccttctgtttagtttcctggttttaataagagcacccctgttgaggagggacatggcaaaagaaaacacattccttccccttcacaagggtgaagcaagtacagaaaccctacagtctcttgtgaataacaccattaatcaagaagaaatccttatttaagggaaaaaagaaacaattatagagttaaatagaagccaaaacacatccatatacatgcatttcctctcccttaggatgagtcagaattcagtgtcatgaatcggcctgtgtcctagcatgcattctaacacgtgcaatcacgttctcctatagcatgaccttcctgcacctctacaaaagagtttcatgctcacatgtagctagaaaggaaacaagaaacacaactgagggtgtactttataaacagcattcagggagtttccaggcctttgtaagtaatgctcttagggtcacaggtgttgcatttgttttctgtgtctttagggtaaagctctctgcaaaggattttactgagggtggtgggtgggattcgaaggctctgggcaaaatgaaacatggtggtctttgatcactccaagccaactaggaagaacacacctatttgtaaaagtccctgatccaagaacattacaattctccacagaaacacaagcaatacacggcaggagaatggggactcaggacttgggcctgaggcacccacacacatagcaacaaagaaaacagcatgcaaacagcagctgcactgccatacagtgaagacggaggctggtttttagatcccacattggagagaacaaagatgtcccaattaatcacaagttagtctagtggaaagttggggcttatgcaccttatcaacaaataaaaagaaaaaaaaccatagtaaatgcatatattttggcatatatttttcatgtatataaaccacagattgcacagacttcctatggccacagctgccagctacattatccctttctgaaacggctttgagaaagaaaatgaaagaggtaaaaatatttccatcttattacctagagagggaaagcgcacgtgcaagtgagtagactgttgtcaggtaattttttgtttgccctaaagactattttaatacagatttctggtaaattttaagtcatctaatacatattttattaaagttgataacaattatcaaagtaccaactttaagttataatatagagaagtcataatttaaaaggcagcaagacaacaagagcaatagtacatcattgaagggaaattcagtaaaagatcactgttattacaaagcactggccatcaggaaaaaaggattaagctctggttctaacaaccctgaaattctcccttcttggaaataagtggaggtaaaacggaacagaaaaaaaaaaaaagtcaaaacaaaataaggccgggcacagtggctcatgcctgtaatcctaacactttgggaggccaaggcgggtggattgcttgaggccagcagttcgagaccagcctggccaacatggtgaaaccccgtctctactaaaaatacaaaaattagccaggtgtgatggtgcaagcctgtaatcccagttactcagggggtggagacacaagaatcacttgtactcgggaggcaaaggtggcagtgaaccgagatcatgccgctgcactctagcctgtgtgacagggtgagattctatcaaaaaacccaaaccaaaacaaaatacaatgcaatcctctattatatgaggcatggagtcacagagcggtgcttcaacaccgagtcttttacttactatgatctgcgttgactaccctgagcctcagttacccaggtgtaaaacaagatgagaaatccctgatttttagcgttattatcaggattgaattaaatgacacagcagtactcgtgaaaggcctcacggaattctaggcatatggcaggcactccataaatggttgttcatacagataatacatacttgtggccttagcataaacccaaggattaactgaaatcttgatcctacatctagaaatatgactgtacaacttgatctaccaagacggcagacaagatagtatacagtaagtaccataatagacttttaaggataacatttttaattacatcaatattcatttttaattactagaaaaactatactttgatcaattgaggctctcttggttataggtaaaacatgcagggataagattctttatcataaataacagaataaattttcggaacattttacatgtgaatgccgctcacttgaatcagtaagtctttttcaaaaatgatcattttatatccctctgttgatctctttgttggggctgtgtgtgtaagaacaagaatgtgcacgtgtggagaaaccaggcgcttccatgtttttaattaaagtatggcaggaatctgtttctgcttctccagaagaacaagtacagaacttccttcacagaacagagaagccacttgaatgaggatttatgctgtgataagaggcaaatatctttaaaatgaagcaattgcataggttattttgtaaatattttattaatcctctaagagcctcctaagtgaggcctcacagatacttagactcttaatctactatgaataaacgtttcaatccagcgcctgcattccaatgatccaggacaacgtggtggggggtggcggggggagtttgtaaggaggtttcgggtatcacaggtgcaactccctatcaaggcacagagccctgcaacacgctgcatcaccagggactgctcgctccagtgattcaaggaggttacaaaagtgcaacaggccttgatgtcagctacgtggttttacatacctactgtgtcagggactcacaaccttcttgtgaatttattcaagtataagagttattttgtttctaacatcatcttgcacctgccactgagctggaagcctgctcacttctcatgtgcatgcagttcacaaatgctggtagtgttctctttagtatgaaagtaaacaaactcttgcttctgcttcctaacaaataatttctttaatgcctttccttgatttcattcacacacctccagttgtagacatacagttacaagatgaatccagagccgcctgcctttcatcacatgcagttcctattaacatttaatgagtgtccattggcaagtctatggattgctttttcctcagccactctctcagaaatcctcctgctgtctctgagctaacccaggatttcctcactcacgttctttacttttttataactcaaaaccatctccatccaccagccaaagaaaaaaattattaaagccagttagaacatgacatgccgacatcaattcaatttggctttattgtaagaattaataaagtgatacatctaagaacagctcaggagccatctcctgagattctgcccccaacttttatattgagataaagcacctatgcctataccttctctaccttctccaaagcttgaattaaatgtttgcctttaagtgtaaactggtgtaaagtggaaaccaaaaccaaatcttgtaactcctgctggcaaaatgattaacacgaagagccaaaagacaaagtttggagaaaagtaagagaaaaaaagccctatctaacaccaggaaaaaactccacataatggaaagtggcaaaggcacacacgaagggctttacttgtaggatactttatcaagtttcttccagctacatcatacctcttccacaatggaaatggcgggggagacagaacctatcatcagtctgcaacacagatccaaagaccagatcattttctccattcctgcttgttcctggtcttcacattgtcctcctttgacaaagagatgcccctccctctttctgttctttgtttttgtgtatgatgttctagttatttaatattatgtctcttttgtgctccagatcctgaatgaccccagctgaagtttcttcccttcatccaggcttgtttgatgtcctagttttatgcccaaattttagaactatcctcttccttctccagaaccgaccatttctggggaactgatcatttcccccgcagcccacccatttccttctttcctcacattactccactggcctctctctttccatttttactactgaaagcaatgttgttctgaaaggtgtgcagggagactagtacactaagagtgtactgactgtgtgtgtaacaggaaacatggatcatctcacagaaaatgagacaggagttaactttcaggagattgaatgagagtgaatgacagcacgttctgacaacattttggaaagttaacaaaaatgactatgctgaaaatttgccactgtgagcatacaagtattaaattcttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcaatctcctgacctcgtgatccgcccgcctcggcctcccaaagtgctgggactacaggcgtgagccaccgcgcccggccaaattcttgactaatctatccaaatgaagggtatacttgatgctatctcaccgcactgacaaaaacagaattaaatttccatttgttgcaaatgacggttacatattaacaatgataggagattattttctaattcctcctccaactacaaaattcacaactgaaaaagacaaaaatagggtcaggcatggtggttcacgtctgtaatcccagcactttgggaggcccggtggctcatgtctgtaatcccagcacttcgggaggccaaggcaggcagatcacttgaggttaggtgtttgagaccacctgggccaacatggcgaaaccttgtctctacttaaaatacaaaaattggccaggcttggtggtgcacacctgtaatcccagctacttgaggctgaaacaagagaattgcttgaacctggaaggcagaggttacagtgagccaagattgtgctaccgaactccagcctaggagacagggcaagaccctgtctccaaaaaaaaaaaaaaaaaaagaaagaagacaaatataaatgatttaaaatgggaggagctagtagtagaccctaataatagctaacaactctttaagatcctcaaataaataaataattgttaaaaatgtatttattcattttctctccaggctgatgttcagacaatctgcacaggactggcatggcacacaggccaatgtctggacatctgctccaagagtacagtgtctttgccattcaggtcattaggattaagattaaatattacccatattattttttaatatttaaatacttaatatttaagtatcaaacaaacctggaagaagggaagaaacttcagctgaggtcattcaggatccgaagcacaaaagagacacaatattaaataactagcacatcatacatgaagacaaagaacaaagacagggaggggcatctctttgcagactgataagattaaataattaatataagattaaatatttcctaaacatatctactttcctttcttctcagaatattttgaaagaacagtctttaatttttgtctcgggttcaagcaattctcatgcctcagcctccatagtagctgtgactacaggtgcctgccaccacgcctggctaatttttgtattttagcagagatggtaactatatcattatatgatgtgatgcaatggttttttcaaaattcatctcctatcctttctacttattaatcctgaaaaagttaaaactaatcatgttcttctttcataagtcttccatcaagatgggtgatgtctgtgactgaactatgatctatatgcttacacctaaataaattaggaagtgatagctcctcctatggcctttccaatgctaacttagccctcaggatgattcagtgaattctaacacacgacttttaatcatttcactctcttgcccaaagttctgtaatggctccctgtcttccagaagagtagtcaacaggcccatgatcagttacaaaatattagcacacagtgccactctggtatatttacaggagtaagattgaaatgtgttaataaggccaggcctggcggctcacgcctgtaatcccaacactttgagaggctaaggcaggtggatgatctgaggtcggcagttcaagaccagcctggccaacatggcaaaaccccatctctactaaaaatacaaaaattagccaggtgtggtggcaggcgcctgtagtcccagctactatggaggcttaggcatgagaatcgcttgaacccaaaaggcagaggttgcaatgagctgagattgtgcaactacactgtagcctgggcgacagtgagactccaactccaaaaaaaaaaaaaaaaaagggttaataaccggtagggccaggcaacaaggcaacaatcaatctgaacagatgccaacatgccattactgattagaacaaacaccagccataaaaacaattattgggtcacaattgtatactggttgactatcacgttcaaattacatacacgtacttacaatactaatatttaatgccttataaatatattacacatataacatgaatattataagacaaattataacaagataaggaaaaaaatcaacagaaattcaacactttcttaacatatctcaataaactgcctaaattagctatctaaaaaaagttccacttaggagatgactggtacagagtatgcaattaaaatgccttcttctggttctggccagggcattcaggcaggagaaggaaataaagggtattcaattaggaaaagaggaagtcaaattgtccctgtttgcagacgacatgactgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttataccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctatagagacacaggcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaactgaacaatgagatcacatggacacaggaaggggaatatcacactctggggactgtggtggggtcgtgggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaattaaaaaaaaaaaaatgccatcttctggataacaaggtctctcatgatctggtgcctgaccaggttcttatgcttcagaaatactgatgcacaaaatcctggaacatgctatcacttcttccaattctatccttgagtggatgctgttctgttactgtgttcctgaaaaactcctaatctcatttctttctttctctttttttttttttttttttgagacaggttctcacctgtcacccaggctggagtgcagtggcaccaacatggctcactgcagccttgacctcctgggctcaagtgattttcctgcctcgaccctccaaagtgctaggattataggcatgagccaccatgcctggccctacactcatttcttgagcatcactttgaatgctacctacctcttttgcaaagtcttccttgactgcccaagacacacttagagactcctttcgctactagagttacaataacaatagctaatatgttttgaacatttgttttccaccaagtattctgctaggtattttatatgcagtatctttatttttttttattttttatttttttgagatggagtctcgctctgtcaccaggctggagtacagaggcatgatctcggctcactgcaacctctgcctcccaggttcaagcaactctcccgcctcagcctcccgaatagctgggactacaggcgtgcaccaccacgcctggctactttttgtatttttagtagagacgaggtttcaccacgttggccagaatggtcttgatctcttgacctcatgatcccacctcggcctcccaaagtgctgggattacaggtgtgagccaccacacccggactatatgcagtatcttgaataatttccccaacaaccaccagaaggtaggtactattatcatctccaagctgaggtttaagaggcttaaaagtgttattcaaggtgacacagctaacagaaggcagaggaggtatctaggcccaaatgtgacactgaggtgcatactcatatacctctagttgtccatatccccaataatacaaatatcacatagcattgcaattgtcagtttgcatgacaacagggatagtaacttttcactcttatattcacagaaaactaatgaaaatgtttgctgaatgaatatatctagttaaaatcttggattttaaaaattaattatgagcttttcagcttatgtgctatggaacattatactttatacctgtgtgtgctttttatattttaaacactgctaacaaactaggtactgtatatgactaaattttagtttataaggagtaaaacttgctttcacctacagcaataagcagctcagaaaaagtgaacatgctctcaaacagtactaatgatttgatatggtttggctctgtccccaccaaaatctcaacttgagtagtatctcccagaattcccacatgttgtaggaaggacccgggggaggtaactgaatcatgggggctggtctttcccatgctgttctcgagatagtgatgaagcctcacgagatttgatgggtttttcaggggtttctgcttttgcttcttcctcattttttctcttgctgtcactatgtaagcagtggctttcgcctctcaccatgattctgaggcctccttagccatggggaactgtaagtccaattaaacctctttttgttcctagtctctggtatgtctttatcagcaacatgaaaacaaactaatacagtaaattggtaccagtagagtggggcgttgctgaaaagacacccgaaaatgtgaaagcgacttaggaactgggtaacaggcagaggctggaacagtttggagggctcaacagacaggaaaatgtggaagtttggaacttcctagagatgtgttgaatggctttgcccaaaatgctgatagcaatatggacaataaaattcagatgacgtggtctcagatgaagatgaggaacttgaagggaactggagcaaaggtgacttttgttatgttttagcaaagagactggcagcattttgcccctgctctagagatctgtggaactttgaacttgagagagatgatttagggttatctggcagaagaaatttctaagcagcaaagcactcaacacttgcatgctgctaatggcattctttttttttttttttttttttttgagatggagtcccgctctgttgcccaggctggagtgcagtggcatgatcttggctcactgcaagctctgcctcccgggttcatgccattctcctgcctcagcctcctgagtagctgggactacaggcgcccaccaccacgcccagctaattttttatatttttagtatagatggggtttcatcatgttagccaggatggtctcaatctcctgacctcatgatccgcccacctcggcctccgaaagtgcttggattacaggcatgagccaccatgcccagccggcattcagttttataagggaagcagagcacaaaagtttaaaaaatttgcaggctgactatgtgatagaaaagaaaaccccattttctggggagaacttcaagccagatgcagaaatttgcataagcagcaaggagcctaatgttaatccccaagaacatggggaaaatgtctccatgccatgtcagagaacttcctgtcagcccctcccatcacaggcccagaggcccagaaggcaaaggtggtttcatgggctgagcccagggtccccatgctgtgtgcagcctaggaacttggtgccctgtatcccagccgctctagctgtggctgaaaggggccaacatacagcttgggctgtggcttcagagggtggaagccccaagccttagcagcttctacatggcgttctgtgcgcagatgcacagaagtcaagaatcgaagtttcggaacctccgcctagatttcagaagatgtatggaaacacctggatgccctggcaaaagtttgctgcaggggcggggccctcatggagaacctctgctgcagcagtgcaaaagggaaacatagggaaggagaccccacacagagtccctgctagggcactgcttcgtggagctgtgagaagagggccaccgacctttagacccgagaatggtaaatccaccgacaacttgtactatgcacctggaaaagacacagacactcaatgccagcccatgaaagcagctgggagggaggttgtcccctgcaaagccacaagggcggagctgcccaagaccatgggaacccacctcttacatcagcgtgatgtggatgtgagacctggagtcaaaggagatcattttgcagctttaaaatttgactgccctgctggatttcagacttgcatgaaccctgtaacccctctgttttggccaatttctcccatttggaatggctgtatttacccaatacctatacctccattgtatctgggaagtaactagcttgcttttgatttttttttttttttttttaagatagagtctcactctgttgcccaggctggagtgcagtggcacgatcttggctcactgcaacccccgcctcccggattcaagcgattctcctgactcagcctcccaagtagctgggactacaggcatgcaccaccatgcccagctgatttttgtagttttagtagagacagggtttcactatgttggccaggctggtctcaaactcctgacctcgtgatccgcccgccttggccacccaaagtgccaggattacaggcgtgagccactgcacccagctgcttgcttttgattttacaggcctgtaggcggaagggactttagccttgtctcagatgagactttggactgtggacttttgggttaatgctgaaatgagttaagactttgggggactgctgggaaggcatgactggttttgaaatgtgaggacataagatttggaggggccaggtgcagaatgatatggtttggctgtgtccccaccaaaatctcaacttgagctgtatctcccagaattcccacatgttgtaggaggcaccgagggggaggtaactgaatcatgggggcgggtctttgccgtgctattcttgcaatagtgaataagtctcacaagatctgatgggtttatcagggctttctgcttttgcttcttcctcattttttctcttgcctctgccatgtaagaagtgcctttcaccttccaccatgattctgaggccttcccagtcatgtggaactgtaagtccaattaaacctctttttgttcccagtttcagttatgtctttatcaacagcatgaaaacgaactaatacatgattttcttaagatctgtaaggatatattccaaaggcctcacaagcactatattgtcctgtagtaacacaaagggaaaggagtctggacagtacaggtatataacctcactgctttctcatcttacttctccttcccctctcacttcctaggagaaagaggggagaaagggtcagtgtgagacagagttgcaggggtaaatagaaaagctggtagtaagcttacatgaggtgctgccctgcatttgtcagtgagaatgatggaaattaggaaaaactgagatctaagccttcaaaacatgttctggtagctttaccttcacctaggttcttatatatacctactctcctctacaggctgtgcactcttttaggataaaaattcagaagaggtcacatggcttagttaccttccaactccttccagactggctcgcctattcactcagtcctaaaccagcctcttagccttcaaacatagtgaaacttctaaaatccaagaatggtccacttcttataatccttcttctttttacatctcttagaggcaagtgctgctttatggaactttagaaatgccaagagatgcaccagaaaattcagccattggaggctcaatgaatagtaaatgaaaggttaatgttggaagttatgagaaacagctacttaatgaaaggggtgaaatataaaaaattaagttttagttatgttgatatggatttgtggatcgtgccaacaggcatcagaagtcagtggacatttgaaaatgtgtaactggtacagaaggaaggtggaagcatgggaaatggacatgggtcatccacagagaggcagcagctgtatgtggatactatggcagagtcccaaggcacatctagacagacaggagacaacagtggaaaaggacacacatctgggagactactttggagctaagcatgatacaagaagagcaaatcaggtggctcttacttctttccctattgaggtgttcctagtgtgtgggcagacaaaatggcacttgtcacagtggaaccttacatctctgcagaagagaagaaactattttaattagcattatacagtggaatgccatggacgaagagtcagaagaattcagattctttaacaaccgaccatccttcaaatttctcatcttcagaaggggatcctacttttttcccttgtggggttctaacaagaaacaaaccggaaagtgctctgtaaaggtaagactgctatacagggatatgaggtagcacttatgaattcctttaagaaactaaagttaacttttctgaattaaaaggctaagaggaagtatattttaaaatataaaaataaaagtgttgatcccagctccaccactgtcaaagcaaccttagacagtcacctcacctctccatgttccaatttaaagtattcaaattccattcctgactatctcatgaagatacgatgatgggaccgggcgtggtggctcatgcgtaatcccagcactttgggaggctgaggcaggtggatcacctgaggttaggagttcgagaccagcctgaccaatatggtgaaactctgtctctactaaaattacaaaaattagccgggtgtggtggtgtactcctgtagtcccagctacttgggaggctgaggcaggagaatcactcgaacccaggaggcggaggttgcagtgagccgagattgtgccactgcactccagcctgggcaacacagcgagactctgtctcaaaaataaataaataagaaataaaaaatttaaaaaagatacgatgatgattaagtacttaaaagtgttttcagatccactgggcaatgtcttaccactcagggggcagtcatgtgatattatagcttgtctaaataacttttcaagctgtgtgatgtttctccaaattctctgggtctttgataccaaagataaacaaagacacccaatcttgactgatgtagcatttgctttaaagttctgagagaactgtaatttttaactgcactaacagaatgcacagtgatcagctgtaaaaattaagtcacttatccttgcatactgaataaaagttaggattatacatcctaattgaaaagaatatctcccaggaaaaaataaattaactccacatacaaatcactatatgttgttttttaaaaattatttcatgaaacagcagaaagaagaacacttgggaacattagatgtgaaaataggcaagagacaatgaggacctgaatgaagggagaaaagtgttcaagggctatttagaaggctgaggcaatggtatttacttagatggctgaggcagcaccatttttctttcttttgttttgtaattgaatagaggaggtgacaaagaggagagcatgggagatgaaccctcaatattgcaccctggatgtcctccaggtatgtgctggtggggagaaggtttgatgagaaagatgagtcaagttattaatacacatactgagaataaagtatctctgcaacactttgttttgaaaattgccttactgactcctagtttatcttcatatagtgtaatagaaaaacgcaaagtgttttaattgcacttgaagctttcgttgaaaaaaaatcaaattggtagaatgtttaactactcagagaatatcccaaaactgagttatttgtagaaggaatattcacataccatagtaattctaatctcccagtcattaaaaaaacccatgatgaacaccacatggtgggctcatcttgggagctctctatcaaaaggtactgaaaatggcattaaagcaaaagaacttcaatcagacttctgtgttccagcttcaacacagaaagaactacatagacctggacagctggaaatgccatgccatatgagattgcagcaaaggagggaaatattaaaaggcttttccacactctaggtacaacactattcagaaagtaggtctgactttacaccatggtgaactccaggaaggctttactctcgtgaaaatagcagagaatctattaaattcatgaagataaggacactgggttagatttttccaagccataatgttagcaggggttaatgtgcctatataatagatgatcttactgtacatataacatagccttgtgaacacatctgtgttcacctgtacacattatatatacttgcctcttaccctaaacatggctatgttttttaaaacaatgtcaaaagttattttagaaactcacactatgttgctatggtgcatgctgctgcaaagaaaaagctaatgggctctctacttaatgtgattacagccattattgacataatgccaggaagacgcaaaaccattagcattacgctacagctcacttaagcatccactcagattcggtatttgatccacaattttaattttgttctgctctattcagagctgcattacacaaaatgcataattaaaagctgctgtgattctctctacttctcaaattaaaaacatagcaaacatttgtagttctaatccactagaaattaataaatcaaacagtgtcttttatcccctttcctccatacaattcagattgcaggttgggaatacttttgcctgcaacagagtatgctacagaaggagcagctgctcaaagaaaagtctccaaactgcctactgtaaaggcaagtgagaacctagagggcctagcagcaccgatagccttacaattccaagctttaagctggaagggttttctggaaagaaaaattttaatcaattcaccataaatccttttgatgcattttccttcattagctcactttgtcaagcatacacatgctcctaatttaatttaatcaaatgcaccatgtctttctgtcaacagtgaagcaattcccgtgtccaaaagatctcctatcaactccctacccaggacagcctagaggggaaactgatgagaacgaggagttttgctttatccaccattaaaactgaaagggtttccccctaaagatctgccatcaagagctgagccactgacgccattcctagttccactgctactagaagccttcatcacttgcaataatagaggatgatgattcattacaataaaaacagtatctactcccctgtggaagataatcctagggaagttctggaagaagtattaaaaacagcagcagagcaaagagggggaatgcgtatctaaacctaggctcccacaccgccctggagtttctcctgtacacacctgaggtgctccctttaggtcgccgtggccagttctttcagcaggccatgcttctccaagtatctcacccctcatcatcaccattttcctcattaattgcaactcatccttcagacctctgctcaaagctcactttgtcaaggaagtgattccagaagtactctagataacttgctttttaacccgtgtgtgtgtgttgttttttttaaaaaaaaaaaaaaactctggcagtttgacactgtcccctccccctagtctgtaagctccaagaaagcagggaccacgggtttatctagctcaccattttaacttctagaacctctcagctttggcacatagtaggcacccaaaaaatacatgtcaaatgactgaatgctgagttaatctactgtgatccaatggtcttcctatacatgccaaatttctgtcattttctacagctatttaatattacaaggtgatcattcctgaaatcgtatttttgaaaaaagcataatgatgcaaggggtttgaaatgtacaaaaattgtccaatttgtgggttttacatgtgtctgtggtagggaaagaacattagcagggagggtgtcagaagtaatgtaggatccagaagagccttcaagaggaaccccgatattcaatgagaacttaaatacaagtgtcccaaaccaccatgttgctccatcagggtagaaaaggagaggacaggaagaaaaggagcaagagagaaaaagacctctccctgaagaacagccaaagtatcatttgggtctgtaatcccagcactttgggaaaccgaggcaggaggatcacttgaggccaggagctggaggttcccaagtgagcaatggtcactccactgccctccagcgtgggtgacagagcaacacactgcctttaaaaagagaaaattttaaaactatcatgcagcttcggaatactctttgattacctttagggtctagtattggcttttaaagaaaatctttccttgataacaatgtgacaaggagattaaaaaaaaaaagtccttgattttcttaacaaatcaagattttaaaatgtctaagcaacagccaaagctgtctcacttagacaatcatttattaatggcaaacttaaacattttttcaaaaagaattagttatttgtctcttactctcttggatctgttttgtaagcttcctgactttaaatttttagctatttcttcttgctgaaaagctaagaacttcatttagacatttaatatatctagactatttccttataaccctaaaaaaagtttaaaaatattcatggggaaacatatataattatatttcatttcagttttaacattatagaattttcttttttatcaaaaatttgatatctctatttctttgtatcatgatcctgaatcaagaggtgttttttcttgaatgctttcaaaaggacaggcatcctcagagtaggcctggagggaaacttcctttggctcctactttagaagcaactcatagaacaaaggggatagtctcctccggtgggggtacctggcccccaatttgaacttctcagcatgtctttttttaggtgcttaggaactaaaatttctccttagaaaaagacttgagcgggcccctgcatctttccatatcctgcaaacagatgacaggagtagtcaggcaggaaaaaaaacccagctgtatctggctcatcacagtctgaggtagttcatttcattgtttcatggctcgaactgttctatgtctttccttccactgggctgaaatctgccttcgtataaatttcggtcctctgagatattaacaaaagcaatatgcttcctggtccacgtggaagcccttacagatggggaggaggactccattctggcaggcttttctccaggccaaacactgtcaatggcttccccgtggtcagtctgcagacccttcaccaccctggtcatgagtggtgatcacatttcaattgctcaatgctcctcatacacagtggtacccagaattaaaagcaagatcccagaagtgatctgtgaagaaggagataataccaccgtaattctgttgttaatgagcaaagacactttttcttaaaaaggcatatgacataaatgacacaaaatacaaacattttcagcttaatatttcttccacatggttataaaatactgcctttttttagatgtaatctataacctaatttctgatcttattcttcaatgaacagtgttagtgtaacagaatattcagcttaaaaacatcttttaccacaaattataagaggaaaggaccattagatgttgtaagtgtagatcacagaatgtacagatgcttattagcttcagaaaatgtgaactccatattaaccatacagctgctggcaaactcttctaggtcaaaaaggaatgtcagtgtgtaagagtacctctaaattgaagtaactattttgtggctccctgcattctcatctctcaaagctcttcccgctcggactaaagaaaagaagcatgaccctgatattaaacagatgaccaataagcaaatgggacttcaattcacaaaaaccaagaggactccaaaaaagaaaaacttggtggttggggctgggcacggtggctcacgcctgtaatcccagcactttggaaggccgaagtgggcagataacctgagatcaggagttcgagaccagcctggtcaacatggtgaaaccctgtctctaccaaaaaaataaaaattagccaggcgcgttggcgcacacctgtaatcccagctactcgggagtctgaggcaggagaactgcttgaatctgggaggcggaggctgcagtgagcccactgcgccactgtactccagcctgggcgacagaacgagactctgtctcaaaaaaaaaaaaaagaaaagaaaagaaaaagaaaaagaaaagaaaaaattggtggttggaaatttatccccaactttgactaaaatgggatttcagagggtgtgttcatgtgtgtgtttcagaccacttcaactgctatctctcatgccaaagaatacagcacctagcaaaagttttcaagtttcaaaaaggttcattttcccttcagtgatagggaggtataagagccttcctcttcaatattttattattaaaattttcaaatacacagaaaagtcgaatgaattgtacagtgagcacttatgtatctaccatctaaattctacaattaacattttattacatttgcttgtaagagtcttttttatgtatcattgatcagcataacagtcctataatttacaattttggggggaaagttcctgatatcactgggtcagcactcatttttaaagtacagaaataaacatttcaagtgcttaagttaggctaatataattttgcttgcatttaagatctgacttctttctttatgcacgttgggtaaaatatttgttagattatttatgtttattttaatagctcggcacaaagatactaaaatgttatctgtaacagcttaacctttggaagaatacttacctttgacagtttccaaatgtttctaaaatctttaaaattatttgcaagctacttgtggtcccccatgaatcagctaaagttattatcataaaataagtatagcagctattataatattcagtatttactatgtggcaagtaccattctaagttcattcaacacatgtaacaacattcaacacaggtaacatcattcgatacatgtaacatctccattaaataggtacttttaatattatcatctccattttaaaaataagaaacatggggcataaagagtcaaagacctcacaagtggcagaaatgggattcaaactctggcaacctagcactgcacacttttcggcttctcagtacactgcacagcctctctagcaaacaaaaacaaccctctgcctgatgaaaacccaatctgttaaatcattaccatcccattgagaggtgacagcgtgctggcagtcctcacagccctcgctcactctcggcgcctcctctgcctgggctcccactttggcggcacttgaggagcccttcagcccaccgctgcactgtgggagcccctttctgggctggccaaggccagagccggctccctcggcttgcagggaggtgtggagggagaggcgggagcaggaaccggggctgcaggcggcgcttgcgggccagctggagttccgggtgggcgtgggcttggcgggccccacacttggagcagcaggccggccctgctggaccgggcaatgaggggtttagcacccgggccagcggctgcggagggtgtactgggtcccccagcagtgccagcccactggcgctgtacttgatttctcaccgggccctagctgccttccggcggggcagggctcgggacctgcagtccgccatgcctgagcctcccaccccctccatgggctcctgtgcggcctgagcctccccgacaagtgccaccccctgctccacggcgcccagtcccatcgaccacccaagggctgaggagtgcgagcacatggcacgggactggcaggcagctccacctgcagcctggtgcgggatccactgggtgaagccagctgggctcctgagtctggtagggaagtgaagaacctttatgtctagctcagggattgtaaatacaccagttggcactctgtatctagctcaaggtttgtaaacgcaccaatcagcaccctgtgtctagctcagggtttgggctctggtggggccttggagaacctttgtgtccatactctgtatctaactaatctgatggggaggtggagaacctttgtgtctagctcagggattgtaaacgcaccaatcagcgccctgtcaaaacagactactcggctctaccaatcagcaggatgtgggtggggccacataagagaataaaagcaggctgcccgagccagcagtggcaacccgctcgggtccccttccacatcgtggaagctttgttctttcgctccttgcaataaatcttgctactgctcactctttgggtccacactgcttttatgagctgtaacactcaccacgaaggtctgcaacttcactcctgaagccagcgagaccacgagcccactagaaggaagaaactccaaacacatccgaacatcagaaagaactccagacacgccaccttaagagctgtaacattcaccgcgagggtccgcgacttcattcttgaagtcagtgagaccaaggacccaccaattccggacacaccatcgctgatatcactgctaacttaggaactggttattttcatttcagaaactgaagcaatgttcaatttcaatgagtattttttaaagccaacaagttgttagtttctgagtaaaaattacatgtacaaggtacagtgtggttataatatatttggaaaagaaagtacagatctacactgagaatgaaattaatgcctatacacaaacacatacagtccaatatgcaaagaatatgtgtgatcttagacaagataattaatttctctgaacctacatccttgttgacaaaatgagggtaatactataatcttagtaccaacttcacgggatcattatgtgaattatactggataatctgagctccaaagtatgtgtaataaaataagtactcaataaatgttagctacaaacacatataaaaaccttagcactatatgtggcacatgctaaatactaaaaactgttgtcagtaataaaaatattagtaataatagaagaccaatatatgtcaataataactaatgttcactgataccacaggggaaattatagatccataattgtgttttaatgttttcaaaagaataagtttaatcttggccaaacacagtcttccagcagattgcatcataaaggatacttctgattaaatcaaaatgactaaatagtactacagcagatttagcagaataatttaatttataaataaatcaaattggtatcagtgcaaggtccctgttggctattatatcccattgtgtcaacccaatagtgttgggaaacctttaaaaaaatgctataaatagtcatctatagaaactcaaactaataggcagaaaaaaaaaaccctcttcttatattgaacaacaaaagaaggaaataaagtctattttgacagtttaaattgtaagctagcaccgatgaaggtgattgcagacactgattctaagactctcgtttctacatactcatagaaggatgatgagacatataatcttacttactttccaaccccacagccggcagataatttagaaaatctgctacttcttctctatcaggaataactgggatcacaagaaaagattcccttccctctgtgtttctaatttaaatgaataaactcagaggaatcaacctctgtatcatcacaaacttcagactccaggactctctggaccagactggggtctcagagaacagccacggagtcactgaacccctcagatggctctaagtgaaaagtcatgcaaaggtccggggctttccgtggccagcccatcagtctactcatgtgtgactaacaccccaactatccatctttctggaccatttagtctttgcaggtacaaatggcaatttgctgtccattttcgattacacatgtattttctccaccacatccaacagcatgtaaaacaaaaagtgccattttgtatacacaaaggcacttaccagggctcagtggatcttaacaccatgcactctgaaaggattaatgatggtgtgatgggaatgagacgggaaatgaaaaactcggttttcccctgtttataccataatgtaacttgattgctaaaatgaaaagtatattctctaccaccttggccactgaaaaagacactgctgaaaccaagaggcttctgtcctgatacaagcaactgaccatatttcatttccttacatactattcccttcctttcatttccattatttcattgctctcaaattacatgtatctgcatggtttcttcaagacacaagattcaaatactataaagctatgtggttttggctgcaggtgggcaatccagtccttaagcagatgctaaacaagaccatgtccaggtttcccaaaattttggtaaaacttatttagcaataattagcaatgattacatggtatacagagtggtatacacagtatatgccatgaaataggaggaagccataaatctccagagatgaaaatattaatttcataccccacatagctaattctattgctattgcaggatcaagaactttgaaaagcatctgctttaactcaaatccaagcaaattcacacgcatatgtggagattattttcagggatacttatttctacagcagcaaaaagggagtgggataaaaggcaagctgcccttgtataagatttcctaaggaatggtccctgagcaaaaggacttgagagccacccatggaagatgtcacggactttcaggcttctaagtactcatcttcaagcatgaccctgtcctaaagcttttctttgctccactcacccaaactactttgtagacttttctatacgccatgggtacttaataaatcctggctgataaaggtaatggcaaaagaaaaatctacccagaactccaaatcccctgccaactcttttattctttctggctctcccaggagaaagtggttgtgattaacttcttaaaatgaccccaaggcttttgacgtggtgtcatgtcccctccaaactcaggcacctctatctgactactgactttctcctgtttacttattaactctgtctcttgttaaattttgaacagtctaggccgttttacaccttatagctcaaaaaaggcagcacagtagctggtgtagggatgtgacagaatgtttttattccacccccgaaataaagctccttgtttttgacacactggaaaatgtacagccagagagtgctcgaggcgaagatgccaccccagccttacatctgtctgctttcatttgtctacaactgtgcttatagataaaacaagctttccagatgtcatcacaagcagggctcatatgctgacttcactgagacaccattgttggctgccagcataacagagttgtaaaactaaaatatttaaactctgagctactcaaaacaactctgaatgtcacacaggatcttatttcgggattaattaatgtacaccccaataaaataatcatgcgttaaaaacagagctggctggcatgcaagtggttctaattttcctttttccaactgttccaatggcatgcaacagcatcatgaagaaatttctgaaggacagcctttatgtatatacccgatcaagctcttaagtttcaggtgctacatttcactgtgccacgacctatatgttctcattgtttaaaacagacataatgaacctaagatgaacaaaagcaatatgccaggcacagactataaagacatttccactgtcagaggggaagaccaatgacaagtgatgggggagattactaataggcattgttttacacatccatatgtgaagcttggcttcaggcaacctggtatcagggagcttgaatgtttgtttgagaacacaatatccctgtggttataattacaaccactgtacaagaagaggactgccgtggtttcataatgcccttaacaaagaagaacacatcattcctgtgcttccagagaaattacacacacacacacagagacacacacagacacacacacacacacacactatttctattttttttctctgaacctgcccaacaatttagttttcactgagtgaacgaaagggagttcagcttccatctaaatgatcgttcctcataaccatctaatacaattgttctgaattggaaaaagaagccctttcacagttgggtacatgagacttccactcatctcccactaacttgggctttcatcctgctctgattaagtctcttgtagcccagtttgcatttttgtaaagttgggtcagggatgttcattaagcatctgttactcaaaaacctgttttgtgggtcattctggttttagaggccaaatccatcacccagccacaagccttctggaatttctgcttaatttaataagagacccaactttgcattaacccagtcaagggatcatataggctctgtcagggccggtcctccaccccactgggctcatttcatgtggctagggcttaccaaaaaattaaaattaaaaagcacattctagcctgagcaacatagtgagaccctgtctctacaaaaagatttttaaaaacagagaagcgtggtggtgcatgcctgtagttccagctgcgtgggaggactgcttgagcccacgagggcgagactgtagtgagctgttaccacaccactgcactctagcctgggcaacagagtgagaccctgtctcaaaaagaaaagagaaaaagaaaaaagcatgttccaggcagtccacaacccttctcaatcccccatttgtacccccaagggtacaaatttatgtggaataaaacatttacttgtgatggctttccaggagaccatttacagagaggaaaaggagggagtcagttactttgctttcccaccatcctgaatgttcccatcttctcttgagctgatcttagttcgaatcctctgaaaataaatcaccccaaagcactcaagatttccccaaggctccagcaggcttcctgctttgttgtttccacccccgtgctgggaggctaatgtgtttgaggaatgttgttttaatgcaaagaacttagaagagtcaaaacaacctgccatagggatccatctgcctctgatgatcctggcctctgtcactcctgtttcagccagaggaaaatgaagtcagaggaaaatgaagacctgggtattaaattctggtcatttctaagtgttaggacagtaattatacttcttgaaatcagaatagtagtatcattcctagttctgtgggacttgatgttccttctttatttggttaaatgtttaggttggggcaggaagaattaatactgaagcacaccctgtacttaatcttctgacacccaaataaatgcgcacaccttttattatcctcccagtactatgcttgggcaatgtcatctgcaagattctcttcatgagattattatgagtgatgcttacactaaccctaattttcagcttttcagcaaacatatattcctcagaaacatttaatgacacattaggctctcaaatatttgcactaaagtttactttctgttctttaaagttctcctgggtttctatagggatgcaaattattaaactgtagcaatttgggagattcacagacaatttttttttttggtagagacagggtctcactctggtgcccaggatggagtgcagtggtgggatcacagctgactgtaacatcaaactcctgggctcaagcgatcctcctgcctcagcctcctgaggagctgggactacaggcacatgacaccatgcctaattttttttatagagataacgtctcgctatgttgcccaggctggtctctcggatcatgcagtcctcccatcttggcctcaaaaagtaccaaaattacagttgtgagccaccatgcttggccatagacatcgttaatctcatttttgccttttaaatccactgggaatccagaagtgacactttctatattccccttttacagatgagaaaagagatgtgtaactcaagttacctgtttgcctaaaggcaagacagtaagcctggggctgagtcagtttacttgaagaacaactagaagcacagtcttgagggggtcaaacgtcctctcctagctacagaccagaggatgtaataacagcagtaagtctgtcggctgggggtggagggggcgggcagttctgaacgctgacacctaacaggacatggagtgttactctcgggtccttatttgaatacaactgcacttaaaaaataacccaatttaacaattcagaagttctgatatatgttttataaaaatgtatgagagacctaaaagccacggagagccataactttgagctgcctcatttgtttctcttttattacagtactgcacagtgggcacaagctcttcactgaaaagagaacattaaatctttattctaaactgttttagcagaacaatattaatagttgaatattattttgtctgacttataaaataccattcaaataagaccaaagagagcactgaaccccagccaagtcctatgagaaaaaagtgacaagctatcttcagaaacaataatttcttgtcactcttaagattccagtaacatgtccactgctatgtaagcccaaaagccgatttcttggaatgaaggtaagctattcagaaataaacatttctctgggtcccccttaacaaggaaagcagccatatgaaatattctttctcttcctcgaatgtctgtgtggtctttcctaatgcaggatcagtaagcaacccatgaggaagccactttgtttccatggatattttaccatagatggtgaaacaggacaagatttaagtttagaagagagggctcaatcccggaaaatattcagccatcagtacaattcaattcagcaaaaaccccaatacgactatttttggccgcatctttggagctctttgctttatctttgtactactaagctacatattccccatagcatgcaaaaaggcaccgtttcccctcgccttatatggcagtgtgggttactacagacaatttcggtgagattagccaaaaaccttaacaatggcctttttcttgggtttccaattttctatcaaattcacaaaggatttttctccccaacgtactatatcttgatattccaaataacataaaaaataaaatattaacaactcataagttaggaagtctgttttctgctctagagacctctttaagtaatcagagtggtgacaacagtactaacagctaaatagggtttacgtaacactagcaggcctatacttacactaatggaaaaattatactgaacctagttggaactcacagaaataaattaagcaactttgtaggaatattcacagtatttctacataaacactactgagtaaaatgttttagtgggaaacaaatttttttctaattagcaaatgaatgcgtttagtctggagatcttttcatgcactaaaatatctaattcagggcttagcctgcaaatatgacagattaagtactgccttatatactgtattgactgtaacttcctataaaaaggaatgctgtagtgaaagcattcatgaaatatttgaatcttaatcccgatcattcagtttgcctgtcactagccaatcaaggagcaaagattaaaggctaaacaagatcaaaaccaaaacagtcttaaaaggtgatggcctgaacaaggataaaggcttcttttagcaaaaaaaaacccaaaaaactgattagtagacccagtaaaaattacaggcaaaaaatggtaggaatcattaaatcatctatattatgtttcagtcattgctaatcactctgctttccaaaatgcctagtaagctcattcagtataaacctatacactaagacaatagaattaaaaattaaaatatgaactttctaagtcagtgttgtcaaacagaaatatgtgatccacagtagtaattttaagcttctaagtaacaattataaaaaagtaaaagaggcaaaacttttaataatgtgtcttacttaataaaacaatccaaaatattgtcagttcaacatattaccaatacaaaaatttgtcagtattttaaatttggtttttgtaatacatctttaaaatctggtattttacctttactgcacatctcaatttggtatggaatacttgaaatgtggctatgcaactaaggaaatcaatttttaatttaatttacatttaaatagacacatgtggctagtggctactgtgctagacagcataggtttatagtttattatctaatttacctttcattgagataagagttttaacatgcagcaaaatcctaggactagagaaatctttaaaaagacaaaatacaaagcatcaatcattgctggtctcagggtaggaaggctgagttgaaatgtatatgcaaatatgatccatggtttacataaatgtgttgctgacatttttcatttccatgcacacatgtggtgatatgtgatttaacatcctaaggagaaaaaacacatcacccatcttcaaagcctctcagttgatattttatgttacctgcctttctccttcccaaaggctaactccatggcaggtttgaagtactctgaaaaggaaacactcctgagtgatttgagtgttacataacgggggctaaaaagtttcttaccctctaaaaatttcatacatatgttcaggtgactcaaaagaatgttaacaaaacttgaggaggcagcagaacttactactcaaaactaccggcagtagaacaagagccctcgtgtatctgccactgattagttacaagaacttgatcaagttattaagttccttacttcttacttaacaatactgtttctccttccctcaaaaaatttttctgcaagaaaacaatacacggatctttctattcttccaataatgctcaaatgcaaatgtctaatttaatacaattcaagtaggaacccctccaaatcaaagacctttctccccattgttagagtgaaagctcactgtattagtccattttcatgctgctgataaagacataccagagactgtgaagaaaaaaaggtttaattggacttacagttccacatggctggggaggcctcagaatcatggtgggaggtgagaggcacttctaacatggcagccgcaagagaaaatgaggaagaagcaaaagcggaaacccctgataaacccatcagatctggagagacttattcaccatcaagagaagagcaagggaacgaccagcccccatgattcaattacctccccctgggtccctcccacaacacgtgggaattctgggagatacaattcaagttgagatttaggtggggacacagccaaaccgtatcactcaccttcctccaaactttcatctaatacacacctttattagtagaaattttagagttttctcacttcatatcagacgtctatgtatctgtgtgggtgtgtgtatgtgtgtgtttaaggacacatctgttttccattagactgtgagcacctagagggaagggaccctggcctagtgattcttatgtttcctcaatcaggtctttcatacagttgtgctgggttgaaagtattctacactccctgaagaagagaagctacaaaaagagaaacatttaagagaagagtcccaactttcaaaggggttcatttggagttgaggagataaacacaactacataacaataaaatgcagtgcagctggtttcatgtcagaatgagcagtccctaatctctaggtgctcaaaggtttgcggaggagtgttccttggaagagagtcaagcagaattgaataaggacttttaggacatgaatcagtggcatataagacctaagatcctacagaccacatggctccatatgagcagaggtgtggaggcggagcacaagtctggaggacagagacgcagacagacaacgtgattgtggtgggttcccacagggcataaaagaatagagactgatacctgaaatgaggatggatctatgttaagcaaggcaccgagagcaaagacaaatatttttacattacatgttgcagtcagtgaaaagccactgagaatcttgaatggagagtgaactgctgagaatgggatttgtgaaaaaaggatcttgccacagctttaaggatacaaatggctggaggcaatgctgctaatcaagtaagatccttccactgcagtgatatactcaacaggtggaaagggtctcatgctggggaggccactcaaatgaagaggaacatgcatttctcagaaatgacaagatctggtaatgacaaaacttaagaggatcagaggtaagggtcaaaataattttaaaaaacacacataaaactcctacagcacacgcagtattccttcaaaataatttttttctagctatattggataccttgatagctggggaaatggcagtaattctaagagagcctgggaaatgggaggaaggcttaagaaaacagtgaatttagtttgggccatattacaatgaaagaggatggaaatttatccaactgaaaaagtcaagtgagcagctgaagatatgcatcataccttgttcacatgtgcactcgctcattaggggtggattaccagtctctaagggttatttcactgcagtttagtttcatctctttttaagttatacagaaacaccaacaaagaaaaagttactactacatgtatgcttacgctaccagattaatcaaaatcgtttttcttctttaaaatatattgatgtccatagcatgctaaataaacaaaactaataaactacactctggtatgctcacatacttccgcttttacaaatcaatttagtcaaggatcagttattttttctcagacctgattataaccgtttcatctacaaatacgattttatcatttaatgaaatattataaaaaccagtgaaatacgattgtaaaataaaaagttcattctatcaaaattaagttgaatgctttagggagtcctgacaatgtttttttcttttttttccccacccttaaaaaaaaaacaaaaacaatcctgctttcacatggtgtgggcaagacaaatgcaaaatattggaggattggatgattctacactcaacctattcatgtctaagttccaggttcactttaaagcagcaagaggtgaaaatcttggtgatacatcacagttgtggtatatgtaagaagtcagaactttaatgagcacaaccatccatacttaagtaaaggccttggctaatctcaaaatgcacatttctatattttcagctaaaaatgcttaaaacatgtagtttgtttgttttggtaaagattcaccacttcaactgattaactggctgttggtcctggttgtgaaaacaggaggaattttctactgcatatgatttctttaaagcaacaaaagcctctgagaattaactttaatatgtgtttacctggcaggttgtaaaggtgttcctgctgtgatgtatggtccactgagaaatcatatgatgtatttcttgtcttttaggaatacaggttatgcatcgaataaataccaaaagctccatccttcgagggtggtaaaggcctgcccatttttttttttttttctgtatagctatccatcaagtctactcaattaatgatgagtagtaagcatcattacaaatcagtcacagaacactgctgctaaaatctttatgggtaatctgaaatggtgtgtcttcagtctgggtagtctgaaacgttgtgtcttaagtcaacttaacatgtaggttaagttttttacaggcatcactaagatgaaattcgtgatcattagtataaataacattcagaatattatgatgccattaagaaaatgtttcctggtgatcatccatactgcagagtatgaaacagacttagagctcccctgctttatttcatttttattgaaaaatttcatagaggaaactgtaattgaatgattaagccactttgttttcacgtaagtcctatttcgaagaaataaagtacgcacgcagaaaaagcactcattatcaacacacaggtaagcaaaaccactgatctgtgtttctcagaaaatacactaaggtgctctatccatttcccaaccagtgcatcctgataggttttagactcaggaaacagttacatctaccttatctgaccacatccagatctggccaacaacctgaagttagaagccatcaattcagaagatcttttcaaagtacaatattgatacaaaaatgatttgaatttttaattaggggtgggtatgtgtaagagggaacaaacaactcattcattcagagctgtcttgagcacctactgtaataaacgtggcaacatggtaggtagactaggtagactaaggatggatgaaatcctgaaataatcttccagttctatgctggcctctgtccctcctttctccagttaataaacatttaagacatgcctatactgtgctatgtgcagactgagactacaaatccaaataagaccctcaaggagcttatgtggtttaatggaagagctaggcaaaaggataaaagtaaggcattcaggttgctcccatgctgggaaagggtactctacttgcacagcagggggctaaggcagtccttctagcagaggtgacttctgagccatgcctgaagagccaaacaggtgaagatgaaccatctaaatagatgcagcagtaagtagaaaggcacagagagtggaggaaagcatggcgtgtttagagagagcagaaagatggaaaagatgtgggcatgtaggacatgaagaagtctgatgacacacgagggtagagaggcaggcaggggccaagttcattcagtcctccactcaactaataggtcttgaccatatgctgcatgtttggttttgtcctaggcactggagatacaacactgaataaaacagacaaacccctaccctggtggagcttaaatcctggtggaagagaaacagacacactaaataaaatacgaaatatattagaaaataattttctttttcttttttttggagacggagtcttgctctgtcaccaggctggagtgcagtgacacaatctcggctcactgcaaactacacctcccagattcaagcgattctcctgtctcagcctcctgagtagctaggattacaggcctgtgccaccatgcccagctaatttttatatttttagtagagatggggtttcaccatgttggccggggtggtctcgatctcttgaactcatgatccacctgccttggcctcccaaagtgctgagattacaggcatgagccaccgagcccagccagaaaataatttttaaggaagaaaagacaaagtggagaaagaggacctgaaatggtgtgggtgaggaaaggctgaaaattcagatacagcagtcagggcaagagtcattgagatgagttctgagtcaaggtctgagatgtgaaggcaaaatttttcagggaaaaggaacagcgaagaagccagtgtgaccaaagttgaacaagtgaaggagggagagaggagatgcagtcagagatgaagggaaaaggagacacgtcatgtaggcctggcacgtcctgtagggttttgatcaagatttggcaggccgtgtagaagagtttggattttcatgagaacacatggacacagggaggggaacatcacacagcagggcctgttgtggggtggagggctgggggagggatagcattaggagaaatacctaatgtaaatgatgagttgatgggtgcagcaaactaacgtggcacatgtatacctatgtaacaaacttgcacattgtgcacgtgtaccctagaacttaaagtataataaaataaaataaaagagtttggatgttctttcaacccaggagaaagtcaatgacgtatcattagcaagtgtgactttccatgagttggagtaaagaacaggttggcggagagaagatcagttaagaggttctgcagagatccaagtggataggggattattacagcctgaataaggtggtgataaatcatcagcctctatctaaattattagcagatcctaaaaaaggacagtcgtagtttaacctcattggctttcttggcctaacatgagagagggtagcaggaggaaaaaaatcaacagcaaatattcccagatattatttaaattcgacataaaatgaaacacttttctgttccatatagtgagatcatgccatgaactctgaggatttggggctcaaaggccaaaagaccactgtggacttaagcagatcacatactcaaaagcaccagcattgtgacgtgaatgtcaatctgaaaaataacatggttcctgggttgcctgtaaacagtgcttgcgttctggctagagatttgggtccggtccttctggggacagggtgctcaacatatgcactgcccaaagtgccaccaaagtggcaagtggtgctgaatgtagttcaggcctggctcaccacggccaagccatgtgctctggtttgggctttatccgctcagaaagaacaccttttctaatttcataaaggctcaacatgagcttgctagggcccagtggctggggcttagaaatctgcacttgatttcatggctctctgaaggttaacgaagactcagacatcagtttgactcaaatctgtaaaactgatcctaacgtaggaaatggctgagactcttaggagtgttacactaccctggactaggcaggctcctactacaaaatgttttgttttcttttttctttttctttttcttttttttttttttaagatggagtttcactcttgttgcccaggctgaaatgcaatggtgtgatcttggcttactacaatctccacctcctgggttcaagtgattctcctgcctcagcctctcaagtagctgggattacaggtgcccaccaccatgcccggctaatctttgtatttttagtagagacagggtttcgccatgttggacaggctggtctctaactcctgacctcaggtgatccgcccgcctcagcctcccaaagtgctgggattacaagcgtgagccactgcacccagccctttagaatgtttcattaaaaacaaaaaaacaaaacaaaacaaaacaaaaacaccataatgataccagaacccatatctaatgtggttctgtgcttcttttactaagataaagaattcggagtctacattttctccctagtcatgattctgtttaggacacacacaaagaatatagtttatttctttagaactaggattggactattaaaaatagcaccattattgtgacaatgacaaatattcagaagagccctaagttgtgcttaagcacaattaccttaatgtcagttgatattttatgatacaactgtgaggcactttatttttaaggcagtttaacctgattccttcatgcctaagaacagacatctaaggtttaaatctaggattcttaataagatgattaagcaatgctctgcagtttctttaaatatttaatataattttcatcacataaatatttacagtttatattttttcttgtgtttatcaggagcaggggatccatatcttttttaaagatggggaggggatgatctcaacaatcaaaatattctaccaagctctttagaagcccaggctatggtgagaaaaccttattcaaatatgtctattcaagccgatgctgtatttaccagacacccagttgctgtttatagggctaggatctggaaggtgtttgcttctaaaggatcttcttacctcacaactttggttccatcatcacatcagcagcctctccgcagtactactaccatcatcaacatggcattagatatgcacgatgctctttttctgaagatagcagagtaattccacacacattaggttgtgatccatatgttctgcagagtcaggcattgcctggcaggaaggggaagggctcagagagtctgttcacccttgtggtcactattgtgcatggccactctggtagcctttttggagctctaatatcagaaaggggtttcctagtcatctcaaagtgtggaacagggaagttccctaaatacccagtttatgatgtaggcctaatttctagatattgcagaaaacagtattcagtatctcatttatcctaaaaacatttctgtgaagtagatgtaggtagttattattctgtccatattagatgatgaaagtatagcactgaaagttttaataatgttaatccaagttggttttatcagcaaaagcagagaccatgccctttgacatatgtctgaatattacatattctctaattcatgaattcattctcaaattcctatttattgcttattatatgccacacattataccggaaaccaagtaccctaaataacaaaacagaaatgatctctgctctcatggacctaaaagtttggtgggggagatgggtataaataaacaaataggtaaacaaatataggactacaaggtataaaaatcgctctaaagaaaatacgtagtggctaagaaaaaagggtaaaagtcatttagattgggtggcatttaagttgaaagtaaagtcggaattaaccaagtaaaaaggttgggctaaaaacatccaccaacataaaggacatactatataccctggaaagaacaattatacagaaaaacgcaggttagccagtcatatctgtgaacagataaagagactttaagaaattctctgttttccaagatacttgtacatgcatgtttacagcagcacaattcacaactgcaaaatcgtggaaccaacccaaatgcccaccgatcaatgagtggataaagaaactgtggtgtgtgtgtgtgtgtgtgtgtgtgtgtgtgtgtgtgtgtatgtattccaccatatatatattccatcatatatattccatcatatatatatattctatcatatatatattccatcatatatatattctatcatatgtatatattctatcatatatatattctatcatatatattccatcatatatatattctatcatatatatattccatcatatatatattccatcatatatatattccatcatatatatatattccatcatatatatatatattccatcatatatatattccatcatatatatatatattccatcatatatatatatgaatatatgatggaacactacgcagccataaaaaggaatgaattaacagcatttgcagtgacctagatgagattggagactactatccaaagtgaagtaacttaggaatggaaaaccaaacaccgtatgtactcactgatatgtgggagctaagctatgaggacgcaaacacctaacaatgatacaacggactttggggacttagggggaagagtgggaggggggtgagggataaaagactacaaatatggtacagtgtatacggctgatgggtgcaccaaaatctcataaatcaccactaaagaacttactcatgtaaccaaataccacctgtaccccaataacttatagaaaaataaaaaataaataaaatctataatcaagaaaaaaaaaagacccccaaaaaattatatgttttcttctgtctcctaccttaatttatgatgcctcatattgggaaacagacctttaccgacaatgaagaagcctggattccaggtccagctctaccactgattctaaatcctattgtccaattctcagtggcccgcagaggaggtgcgtgtccctgccaggggttgtcaccatcttctctgggctactggatatcaaatagtagaataatgtgaatacaaacaacagaaactctacaaatactagacagattgaacatatttaataaccgttttattagttaacacaattactatacctgccataagaaaagcacaggtatgttcagcacttacaacaaaccacaatgtaatcaaattcccattttaaaatatggacgctaatgattatagttaaaatacactgcactcttactatttgttgggcatcatgccaaggactttcttatataaataagaattaaatctcacttaattcttagtaaatcttccaaggtgggtattactattctcatttaacaaatgagaaaactgaggctcagtcagttaagttacttttttgaggtcaatgtggaggttactgcttacttaggcagtctgattccagagcctatgtttagaaattagtttgtattaatctactgttaattaattaaatattaattatattactagaaaatgacctggcattttaattataccacactaaatcacaccaattcttcctctggtgtatctcaagcccatcccttatctttccatttgcactgccatcaaatatagctcctccctaaatatctttttttttctttttttttttttttttgagacagagtctcactctgttgtccaagctggagtgcaatggcacaatctcagctcactgtaacttctgcctcctgggttcaagcaattctcgtgcctcagcttcccaagtagctgggactacaggcgcctgccaccctgtctggctaactttttgaatttttagtagagatggggtttcaccatattggccaggagggtcttgaactcctgacctcaagtgataagcctgcctcagcctcccaaagtgctgggattacaggcatgagctactgcacctggccctccctaaatatcttaaatagccttctaattggttctcctggctaagaaaatatgatcaatcttcattctaactactcaatttactactatcatactaaggctcttggaactcagctttctggatttcattcttccactttaaaccttcagtaatcccagactatgaaatggggccccatttcatagctgggaattcacaaactcccagattcttagcctagtggcctgctactcccaactcctcctcaattcctgcagcccagcccactggctgaaacatgtctctagccacatgcatgctgactctaccctggtttccactacattccctctctcctctaccccttttcaagactattctcctcaccattcagaatcctacccatccaccaaactcaactcaagtctgatgtgtctcattaagcctgctccagtttttagtaaccttgcctgtccccaaaccctgggcatttaatgaacatccaattcatttgacttcttgccaactcctgcattcttatttaatgtttacccttttaattttctaaatgtatagcacttgtctcgggaaccatatgaaagctgatagcaagaacaaacaatttttttctttgattttctaagggttccaaacccaaaacacataaataaaaaaaatctagaatgaacaaaacatttcactcacttgaagtatatatatagctcatatatgactaaacaattacagagtctactttgtccttgcccatacagtcataaatgcaagtctgagttatgctaaccaatcttctatatgcgcttgcaaattttggccaaagaatttagtttttcagggtggatggagcaggaggcatgagggagggaaaataatgatcatcccttaatcattttaaaatacagatgtgaaaaaagcatttctagtggcaaaataggacacacccatcactctgttttaagagtacactactactatctgttggtgctttatacctaaataaagtccttttgcaggaatgagacaggtggttattgggttgtctaatgtctcacaactagtaactaaccatcagtatttgaaccaatctgtataagacagtggtgtgtcttctagtatcctggtataaatcatactaagacagtggttaacagcatggactccagagctagactgtgtgagttcaaatcccagctctgccacttataactatatgatattgaacaagttacctaagtgatctgcgtcttagttttcctctttgtaaaataaagttagtaatcatacttactacagagttggtgtggtaacaaaatgagcaaatataagtaacgcacttaaaattatatatgtgctctctaatgctattatgattgtacaataacagaaatgtaattagcctttcaaacattcttctgaagggagtctttattattcatacgaatgagtaatgcttaacattttcaccaaaaatcttgaggaacaagggaagtaacttatctcatgagtcagcaatgaaaaccattcctcaacacacctcttgactgatgataataatgataccaatgctttttatataaccttctcaaagtttacaacttttcaacacttttcatacattttaccatcacaaccactcagtgagatggatggatagatggctgggtgtccaaatggaagatgaaagatatataaaaccttagagtcagatgacttcattagggttgagtagctcttgcagagcctaatacatgcttttagaactaaactccagtctcccacagtctgcataacatagagtatttctctacagttcacttatcctgagatacatagaaaatctaagaagcataaataagggccctaaaaactctctgtccacaattggtttgatggaaacgctgatcccattaggggctggatgaatggctaagtgggttttaaaaaagcgaatgtaaccaacactcaaaggaaggtcaggaagctaaggtctatgttaccctgacctctggtaaggtaggtaagacacccacagaaaactacagcctctactccattggttgaattgctaaagaacagagaataagtgactaagcctggggaataccaagacactttgccattttcttgcatatttaaaatgcatttctaatttgtaagggcttttttgactgctagtcccaagaaaaaggtctcctcagataaatgagtttaggaaatgtaacatatcctttttttggttggcatggaaggagtgggggtctagtggtttatgcctgtaatcctagatctttgggaagtcgagatgggaggataacttgagggtaggagtttgagactagcctgggcaacatggtgagatcccacctgtacaaaaaataagaaaaattagccagacgtgatggcacacatctgtagtgctagctacttggaaggatcacttgaattcagttcaaggtcacagcgagctatggtcacgccactgcattctagcctgggcgacagagcaagactctgtctctaacaacaaaaagaagtttctaaaaagttttgaatataggattgggttaatttttttttttaacacaggctttcccaaacttatcagatctttgtaacttttaaagcacaacagttactaacattccatagaataaatggttttgggatacccttggggacactagtttagacacatttccacactgttttgttttgtcttttttccccccctcttacttcttcttggggtgaatggcttacttgaagaatatcattctgcacttagctttctgtctgctcagatttagagtcaaggtcttccacaggtctgaggaagccacagaatcatgtaggaaagctatacaaagtcatagccagaattgcaggaaaatcatactttacataaaaatataaagatgttccatttcaaaagattgtatcaacagtaagatttattctgctgaaaagaaagtctgtgaattggtatacaggcttttacttgatgaagagatggggttaatcccacagagggcaaaacaaaggcataaatatcagaaggtggtttcatgtggcctcatgaagtacctaaaggaagagctacaacaagcgtattctaatctaccctagatttatgggattgtaactcaatcaatgaaagcgtaccaagactttccaaaagcacatggaagttaaatgaattcatgacagttaaatgaattgtctcttgccctgagataaattttcacatgaagaagagaaattgcgcacagtttgctacagagagtatttgaaagaaaaacagaaaagaatataagaggaaaaacatttttaaagtgtaatatatatggtttaccaccctcctccagccccctcccacaattttgtcccaaaacgttacaacaaacatcatttctaaggaactctgggtatagccaagaacgaggatattttgagggtcaaaaaacaaagcagaatatcattcttcctgggccaagctccaaacactataccacggatgtgcagaaggagacaaattaacaatcctgtgcctactctaattcatgccctcacaatccatctaactttttttttactcatttttgtttccctaagaatttttttttctaaatcaaaaatacaaaatacatgggcccaaaggcagtgaggaaaggggagaggacattcatgtttcagtcaacatcaggaaatacagtcactcgttgagaactaggtctctaatcatatggtgataggacaaattcaagaaataggaaaatggggtcaagcagtctctcaaaaaaatctgattaatgataatctggaagagtggacctaaataaggcatatctcaactttttactatcactgatatccacagacatgacaatgtttactcaagtttttctttgtcaccagaatgttataaatatatatggatatacaaactacaaatcaataacacctttataaataccttaaggaccattatttagcaattatgtgggcctcttcatgtgccaacacaatacacttttcaacatgccaataaacccattaaacatatttatggtgatagttattaagttcaagaggttttatccaggaattatagttcagtaagaaaaataaccttgtagtgaatcagaaaacatacttattctagtcaagaaatgaatatactctgatcttataaacatacccagcacctacaggcaagtcggaatccatatggcaaatttaagcaaaaacacatcacctgcacctactagatgtcatcttagcaacagcacccatttatctaagtcatagtttcctcatctgcgaaataaggattattttcctacactgtatgtgaaaatgcttataaagataagtaatcatgttccaaaaaaagtagttagtcataccatttactgagaatcaaacttcttaaagtttggaataatacatgtattccagaatgaatacatgtattaatacatgtattccagaatgaatacatgtattaatacatgtattccagaatccaagtccacatattctgaaataattgtcttcctctctcacaattatatctattccaaatgatacaagatgcttcatgaacctctgtgacatactgactcccaaaatagactggttaataactttgctttttccctgaattcagattaaaatgtaaactcttaaataaagtagaccctgaaagctgcaagaaagatacagaccctccaaatactggagatcagtcaagatttgataaattccattatctctagatcttctgtaaaaaactagaaataaataaataaaaatttcaatactaaaaatgtgttctcatcctgcgctaacaaattagaactgtggaaccagccaggcacagtaggacatgcctatagtcccagctactgaggaagctgaggcggcaggatcacttgaggccagctgttcgaggttgcagtgtgccatgaccgcacctgtgaacagccactccactccagcatgggcaacacagcaagacctcatctcttaaaaaacaaaaaaccccacaaaactgtgggaccatgtaatggttacaagaagctcaaattctaggtaacattattttaaacagtgtcatctttggaatttctttatcatgtagtaggtaaaagagaagactatgaagtcaactgtccaggtttgaaacacaactatctgccactcacaacgtaagttgaggcaatactgctaacttttctgagccttgtttccctcatctgtaaaatggaaagaacagaacctatcttctgggaagataaatgagataaaatgtataaatgagataaaatgtataaaagagatgcagcacagaactcagaaataattataactgtcaagtcagtgctatcctgcctgagtagcaaatcacatcccacaccatgccactgcaattttccagtaacagtcaccactgcttggggcccagtactgacattttttgctctaatctttgtttatagaaggagtaaataatcgaaacaaagaacattccagtatgcagtgctgatggttacacgataaggcagggccaggcaccaacactaagactggctatctatgaaggtgaaaacacataactttgataatgaagctgtctcctgatttatagaagctaggctgtcttaactcttgggattcagagccaaccaaggtctggagaaaactctgcctggagggagagagccaaatatgcagccaggatttaaagagagaagattttaagcttgaaacactaaagctgttctaaaagaaaatagtgctttaagtttacagagaaaactttttaaaagagaatcagaaagattctgagtccttatcagtaacagttaaagacaaaaaaaaatcatatatagttccctctcctaaattcatccattaatcacagtgctaagaacttcaatcaggtgatttgaatttcatgttagcattcgtaataatattaacaccccaagcagaacaagtcagtttctgaagctgtaaggccagagtctcattttagcacatttgtaggacagtcacaggtacacaaagtcgcattaaccacatttacaatctctttcaaaaattctggagtacagcaaccagaaacacttcctcaaataaaaagcataattgtagctttctggaagctcttttcacttttagtccaaagacttagtaagaagtggactctgaaaagccagttgacgaaactggcacagacactgggccatgaaagcttttaaaaatctatcgcaaacttttcccattaaaacttggatggaaattgtagaaaagtttttacctttttaatggtcaagtgtaggttaaaaaaaatactgagttccacaaactttttacaggcataacaagtttttagaaaagtcacaaaaatacttatgtgagagtagacgaaggccacccactcggctctggatgagacctcaaaagaccttcaggaagacaaccattatttgtcaaggaaagtcctggatataactagcttctttcctgtgactcttcttaatcccacgcttaagtgaaattatctgctgtttcctaaataggtctcatgattttctgaccctgtgtcatctggcaagttgaaattttatctacccttactggatcagataaagtacacttctctctctctctctcctctttttttttttttttttttttttttttttttgacggaatctcaccttgtcgcccaggcttggaatgcaatggtgcaatctcagctcactgcaacctccacctccttgcttcaaacgattctcctgcctcagcctcccgagtagctgggattacagtcacccgccaccacacccagctaatttttgtatttttagttgagacggggtttcaccatgttggccaggctgtttgtttggttttttttgtttgtttgtttgtttggagttttgctcttgtcacccaggctggagtgcagtggtgcaatctgggctcactgcctcctctgcctcctgggttcaagtgatgctcctgcctcagcctcccgagtagctaggattacaggcacatgccaccacactcggctaatttttgtatttttagtaagagacaaggtttcacaccacattgaccaggctggtcttgaactcctgacctcagtgatctgcccacctcagcctcccaaagggctgggattacaggcatgagccaccaagcccagcctacacttctctataaggcccgcctgaccttctggaataaaaggaacctttcctactttcaaaaacttctacagcactttatatctagacatctcatattgtacatagtattttctaccaaacagtgcagttattaatagagaaatctcatctttctcccttgtctacaagccttttgagggcagtgtgtccatttgctttttttttttttttttttttttttgagacggagtctcgttctgtcgcccataccggagtgtggagtgcagtggcttgatcttggctcagcctacgcctcctgggttcaaacgattctcctgcctcagcctcccaagtagctgaggctacaggcgcatgcccccacacctagctcatttttttcctttggttttttgagacgaagtctcactctgttgcccaagctggagtgcagtgacacaatttcagcttactgcaacctccacctcccgggttcaagcgattctcctgcctcagcctcctgagtagctgggactacaggcacgcaccaccatgcctggctaatttttgtatttttagtagagacagggtttcattatgttggccaggttggtcttgaactcctgaccttgtgatccgcctgccttggcttcccaaagtgctgggattacaggtgcgagccaccgcgcctggcctatttccttcttctacgcttccattcaacaacttgctcatatagtaggtccataataaacacttagtaataaataaatgaaccttaattacacatagcactagtacaaacccaaatataattgagaatattctcccacttgcttaaagcggccaaactattgagaacattccaaaatagagttaaatggaacagtacataacaatcgttcattattataatacttcactaccaatgagaatgcaaattacagaaaattttagtcattgagtattgatgacctatcaagcattttactaggcacagagtataagaagataagcaagaaatactttctctgccacaaggaatttgaagtctagtgagagagataaaacaggtaacaacagcatataaagtttaagtactgcaacaaaggtccgcattgcttctttgtccataattcaacacactaacaaattttaagattctgctataaaccctaaaaggagacttacttattctgctccataggtcctcaggacttctggtcaaagacatcttggacttgatcatcgcggacatttccaacacatcagtcaactcttaaacaggttttggtatgtagaattcttgccacatacttgggtagactgtatcaccaacatcttgcaattaataatacaaagcaacaaaagagacacagtccttcgatctctcactattaatgctcagtaaaaaaacatcataattcttgttgattctctccctacaagacgttcaagccactatccattctgttgtatttctggcatgtacatgttggcttgaatatctgaagaaaattcttctaatttcttcacacctgaatttattatggccagaattctttggtcatgaaattttcatcctattgttccacgcaggtcaaaattcttattggttcttggctctttatgcccagaggcccaaatccaaattttcatacactatgctagcccccacaaagttaatttttcaactatctgcttttcttctatccaggatattctgccttctgcccacaaatcagtctacttctctactctttccctcctctgtgtatgttttgcacatctttttttttttttctttttaggacattgtcttgctctgtcaccgaggctggggtgcagtggcacaattagctcattgtaacctcgaacttctgagcccaagcaatcctcctgcctcagcctcccaagtagctgggactacaagtacatgctatcacacctggctgtttttttaattattattatttttagtaaagacagagtcttactatgttgcccaggctggtcttgaactcctggcctcaaactccttccctcagcctcccaaagcattgagattacaaccgtaagccaccatgttcagccaatgttttgcacatcttaaactcaccccaaatgtccacttcatcttcagcaactttgatatctaggcacaagtctcaccttctccaggaagctgtcaaagaaagccacctggctctggtatcttctcttacagatcacctcaacacttaaatcctcaaattctaacatatacatttctacttattggcatataaatgttggtaaatgtactacaatcatttcatgcaaggcagctgttgtctacagtcctcgaggacaggaaacacataaatgtctctaactgttgggagtaaggaccttgcacacataagttactcagccaatttcactagtaacattggtatcagacatactgggaatccataccacgtcacaaggttttctaaaacagtattaagaaacaaccgactcctctgtgcatatccatcccagttacagaaaaccaggatagcaaaaggaacagtttaaactgagagtaagtcaaagttactaacctgggtaaaagtaattctgaaggcttcaaagatctattcagttccataccaaagtataaggttccaaaacctgtcaaatttctattcaggaaagcaggaaaattgttatctggccaaagaaagcagtattacttgctattttaaaaagaatctccaaagctccaagttataaagtcatttaactactaaagaagaaatatgtagaggttgtttgtacatttctaagaaacagaggtcacctggatgaactttcaactgtaatggttagctgacatggttctctgtccagattttgggttctaaaattaaggtgactttgagtgcaagtatttttgaagattctaggctgtttccaggtcttacactggttagaccattttttcttctggtgtctagcaaatggctaaaagacctgtttgtatctcagatgttggagaaaccgttcaggaacaattcatctctgcaaggctatgagtcataacacattgccacggtcagggagacctctgttaatcaaggaagcgctagccacacattcactcaagctgtcttagagaagctggcctcagtgcccactgttctttttccacagatcatcagtcatctctacaaaagagaaaatgtccaacttcctcactgggtggacagcctcctgctaggcctgcatcctggtttcctttctgctgagttgctgattttcctagaggtgcacaatagctaccaaaaggaaagtctcctacttcgtcatgaaaagaaagcaaggagatccacttaacgcccctctgtaataaaattaggatataaaaaggcaggaaacacagaggtatctgacctcctttcacgtactctttcttctttcgcttacccttacatttggtgtataatctacaaagtcagggaaattcaccaagtcccgacatagctacatgctgtatatatttgcaccagctcttcaaatacaagacctaaaacttggttaatttctttttcctaggtcagaaatcaacagataagcctttacagatttttgaatcatttcctcttcctcaaactatggcacatgacaggatagggaaggtgtagaggaaattccaggggaataaattgacctacaaatgttatcaaattttatcactgagtgatggatgaaattctcaggtgattcactgccagggtggtatttggtgctaaagtgagggaactgaaaatttaactgagctagctggcttcactttgtctttaatctgagtaatgattgcgagattttacatgggcaaaatattacatttccttccagatgacctcaatatgcaattctcattgaaatactttttcagacctacacatatacctgaaggctgtcaggaaacacacatttgttccacaaaaggcagagagaaggataggcaaaacttggaatagccacttagcttttgtttaatatgaaatctttctcagaaaagctaatggagatcactaaacttactttttttttttttttttttttaagaaacaggtcttgttctgtcacccaggctggagtgcagtggtgcgatcatacctcactacagcctcaaactcctgggctcacaggatccttccacctcagcctcctgagtaggtgagactacaggcacctgacaccatgtctggctggtttttaaatttttttgtaaagaaagggtcttgctatgttacccaggctggtcttgaacttctggactcaagggattgtcccacctcgttttcccaaagcactgggatcacagccatgagccaccatgcctggcaataaatttactttttttttttttttttttttttttgaggcagggtcttgctttgtcacccaggctggactgcagtggctcaaacatagctcactgcagtctcaacctcccaggctcaagtgatcctcctacctcattctcccaagtagctgggactataggtgtaagccaccatgcctggctaatttttgtatttttttgtagagacggggtttcgctgtgttgcccaggcaggtcttgaacttctgagctcaaggaatccatgggcctcagccccccaaagtgctgagattacaggcgtgagacacactgcacctggctaataaatatactcttaacctaactccaggggcagaagaataaagaccttttgccgataaagtaagcaaaggtattttttcatgtatcatagaagtaatactatttcaccaaaacaagcacaaggccatcacactaaaggatttgtgtacttgtgtgtctgtgccagccaataatacattaaaacattcatttaaaattccatcaaaagtgctctccgtaaaaatctcattatgatacttataatactaatgcaaatatatacaacagaatcaaaaatttatgtgaaacctacttttatttgtttgaatcaagcgattaatctattgatctattttacctattaatctattgtatacacatgtgaatacacacaaacataatttgaagaaagcttcacacgcattaccctcctcaatattaatattttttctttccttgaagtgatgaggaaatgaaatccttaaaagggtgtttgatcatcaaattactgatgaaattattctattctgtcaaatagaaggactgagtacttttaaaaatcatgctatttcaacatgtggtaaataaaattctgagcaatttaaaaagttattgttactgaggacactaaaatatcatgagtcataataatcctcaagccaataactcacaatcaaactgatgagagcttgtttctgcctccgtggcataacctgtaaaatgggataatgctgacacacagcagtcctaaagaccaataaaggtaacacacgcgcacacacacacacacacacacaaatagaacctgagcacaatgtaattaaataaacaaccaactgaactaacttgttgcatgatgacaaaggcacatctaataaaactactttgttgttttactttatacatttatttgcgaggttagtatgtggacaaacacatcttttatgtacactataaaactttgatgttttaaggggtttctataaaaaactagtaagaatctttttgatataaaagtatcatttttcatcaaataaaacaatcatctcaaccatcaattagttgttttactggagaagggtagcactggcataaagcataactttcttcatacaaaataaacttttaaaaaataatgagatatggctgggcgtggtggctcatgcctgaaatccaaacactttgggaggctgaggggggaagatcacttgaggccaggatttcgagaccagcctggccaacatggtgaaacccgtctccactaaaaatagaaaaattagctgggtattttggcgcatgtttgtaatcccagctacttgggaggctgagacatgagaatcgcttgaacctgcagaggttgcagggagctgagatcacaccagtgcactccagcctgggtgacagaatgagactctgtctcaaatgaaataaaaaagaaaagaaaagaaaaacataataatgaaataaagtgttcatgcaaatgaaaggtatagaatgttatttattactattttcccctcaaaatgtgaaaactttattaaagtaaatagcttttatgaagacacgggtctaagacatgagaaaaggttctttttttttttttttttttttttttgagacagagtctcgctctgttgcccaggctggagtgcagtggcacgatctcggctcactgcaagctctgcctcctgggttcacaccattctcctgcctcagcctcccgagtagctggggctacaggtgcctgccaccatgccccgctaattttttgtatttttagtggagacgggtttcaccatattagccaggatggtctcgatttcctgacctcgtgatcctcccgcctcggcctcccaagtgctgggatcacaggcatgagccaccgcgccaggccgaaaaggttcttaataaataagaaatttctctagtacaacgaaacacagaggggtacaggaccaggaagaaaactagactcttctttgaaagatgctagtttcattcagagttgtacatgagtccatagtcgggaaggaccgtaggttgaagactgacacacaactcagaagagagaagggcagtcatgggcctggggattagagctacaggtgaaatactatgaatgatgaactagggagtttcttaatggaacttcctatggattagcaaattcatggggttcaaaacattaggctgttattccaccctacgctcgtgtttatgccctatgagattaaatgttagcttccgtgaaggcccaaaactaatttcttttcaaaaatattagcaagaatattattagccagataagcaggaatcacctatacgtgtggctatctcctgcaactttcttctctgagatggcaggatgtcacagttttccagtggaaatctgaaccaccaaagtcctttctacaccctggtccaacccttcagtgaagcaccaccagccagcaaggcaggttcacctgattactcaagattcgtctggtttcaagggatgaaatacttctattgtctccagaccatgcagcctgagagttactaggtttcaaaccaaattttcatgttccttctgtgcaaagaataaatgtactctctaccattcaaagaggatagctgccaacacacccctgactggtctgagtggctgaaattccactgggaggacaacaaaaggaagtggggcttcagtatgcagagcagggagatcagaatgatgagcaaaagccagaatcttttgttatgtgtttttcacccaatgctgacatctaattgtttagatttttttttaaaaaggggggaaaaatactggtaataaaggagaggttctgaaaaagcagctctgtactagcaatctgttatctgtatcataaactttctttcctctcttatttatctttcagatgtttacagttgacatgcaaatttcagttgtcctcccaccaacaggtgagcacatttgtttcttttttgaattgtaataataacatttttcttctaaggagtcttaatttctatagtcaccaggaactgttgttagcaagggatccacgtctcgatgatgacagaattgaaaaacaaacaaacaaacaaaaaaacactttcacatggagagagaaataagtagttgtcaacaaaaccatttctttcttcattgctaatggcaatcactggataagcagatcatcttgattttaaaaattccaattattgaactccaaaccaccacattgattactgattccagatatatattctggtttctggaaccagcaaaactgtctggcagttacactgacccagaagggaacagacgggaggaaagagaactccctttaatgcacagctatcagtactgttggctatttacataattcttgcatcaataggaccactgaacaagtgttaatattgcaagtggaagcaacatccagagggaattcaacatcattagctgcatggagcagagcatggagatccgagagggaatcatgtcagctccaagaagccaatagtctgtggctgtcagtgtctgaaatggagccgcttcaaagccgactgggctgtgacctgaacactgcatccctgcgcccggtgagaagaggatcaatgactgtgtttgctgggctccagtcatccccttggctaatgaaagctgtgctgaaaggaatgctacggggcctctgggcagcctgcagcctggcattagcggagcttggctggtgaatgcacccggcaccaaagcctccctcaccctcacccgccctcttccctgttctatcccaccaactcccctctggctgtctgtttagtgtcactcagttgggatggatcccgttaaagatctgacgcttagtgaggactcggaggtgtctggaacgtctgtctctaatcataaacaccacagctggcaatgatgtggtcgaaaaaaaatcaccttgatccagtacacattctctttgatgtctctgcagtgagttcactgcccagagaaaaaggtacaatttgaaaaaaaaaaaaaatttaaaaaaaacctctgaaaaaaaaaatcaagcttgacattctcaaatcataaccatatgactttcaattccatgctaaaaaaaagatatatatatatatacatctcattgcattatgttctaagaaattcagaaaagaggcatctgacaattgtaacatgaaacaggtttggaagataatggcagtttgagaggaaaacacttccaaaagggaaaaaaaaaaaagtcagactgccactaccataaaaggaagaagtcttctgccaaagattgcaaactgcagtgaccttaagtaagagactgtagctgattcaagggaaaatgaaaacttttcaaagacaacactgcttgagctgagccactgtttctaagtgccttatgccctcttgcctttcgggtggcctggtaaacacacagcctaactgtgcttccagccccaggccgcagggttctaatgaatattcagccacattaacatgcattttctttgtgttgttcttggtttgtttgttttttttcagtcctaccaagatggggctggtgtagataacgttcttgtgatgccgcctcaggtatcagaactctgagaagcgtttgcaagttaaatgctaagattccccaatgattatgcggaaacttaaaaaaaaaaaaactaaccacactaacctaaagaagcgagtttacagtggataacagttatgcagctgtcaagataactcatgagaccttctataccaactgagataaatatcacttatgtatcatcaatgtccaaattacatacataggtacccagaaacccccccaatacagggtgagaactcaaagagtctttatttctatcccaaagcgggttctttctagtacacacagtctaaatatacaaacaagcacacaaaacaaactcagttaaatgtgtgcttctttttttttcttttttcatcttaaaatccaaagtcatttgaaaaatctcttaagactaataggagactaattattaatttatagttttatcttaataaaaaagtgaataaaaaggtgttttaatccagatagttttaaaatttgtcgtattaaaagcatctcttatgcttattccaaatgtagtaaaataatcaggtgattctaactctaaatgaggtaaacgttaattagatgtttctggtttctttgattgtgagcaaaatagcaaaaggctttaaactggtcagttgcactgtgacacaaccaatgtttaagaaatcactctgtaaacggcatccaggaatgcagcaccaacacttgcagtaacaatatccagacgaagccaaaaagtttggatactgctgtgttgttctaaactgactgaggttttgaggactaacaacattcccccataatgatggtggtgtctttagattgagataagattcaaatttattgagggttatttactgttgtgtataaggttctgtgtgttgaggagggaagtagccagttggaggagggcaacttggctgggctcacagctgagaaacctcaggagcttgcatatccctataaggtaatttctttccttttttaacataggcaaggtaattaaatgttagtcaatcttaacagactgaaaggcaaggatatgctactatatactgaaatactggcattcactgcaatatttgccttacagtattaaggctttagtggtatctcattaaataaataaagctctacaaaatgttttagcccaattctgatcatgagtatgtgttttaaacagtattgcttgccagaaagaaggggcagtgggagggtaattcctatatgctgtaatttacctgacaaattaattgcaaacacacacacacgtacacaagtgcacacaaacttaagtaaatgtacaaacctgacctggtgtcctatgatgcaaagcattacatttacaagagcataaagttcattagtttacttccttcctccaaagcttaaaggagacaaaaaaatcatatcattcatttcatttttgaaaggaaatatgcctggggtgtttatataaacacagtaaattgtaggttccatgtaaccatatacatttttatttctaaagcagggtggacaagtcatagggtcctgagttttctaagatgattaatatactagataattgcagaattctcagccatacttcagatgtgtaaaccaatccgaaatggtacttggcacaaatatctcatgccagggtttctaccaaatcccttaaaacttactggtctcgaaggaacacagactggttattgggcctaccagttgcatcttgagagtgaaatctggaaagaagggacaatagatgtgtgtattcattttctattatatatacttcggtgtagcttgaattatttataaaaatataataatgaaaattaaatttaaaaatatggctgaacgtggttgctcatgcatgtaatcctagtactttgggaggccaaggcgggaggatcacttagcccaggagttcaagaccagcctgggcaacatagggagaccctgtctctattaaacataaaaaatacaaaattagctgggcatggcggtgtgcacctgtggtcccagctactcagtaggctgaggtgggaggattgcaaaaacccaggaggtcaaggctgtactgagtactccactgcactccagccagtgtaatagggcgaaaccatatctttaaaaataataataataaaataaaaatagaaaacatgccttttaggtataaagggcaaatgcccccaccttactattattaatcatattctactaaagtctctgttacatgagatttgggatgtacaggtgcaaaagtcatatatatatatattttttgttgttgttgttgttgtttgtttgttttttgttttttgttttgtttttgagacagagtcttgctggagtgcagtagcaccgtcttggctcactgcaacctctgtctcccgggttcacgtgattctcctgcctcagcctcctgagtagctgggactacaggtgcccaccaccatgcctggctaatgtttgtatttttggtagggacagggtttcatcatgttggtcaggctggtcccgatctcctgacctcaggcaatccacctgcctcggcctccccaagtgcagggattacaggcgtgagccactgagcccggccctaaagtcatattttaataaaaccagaaaacaaatgtctttatcatatagtttggtgagtcaaacaaacaaacaaaaagcaagtgtgttatcagcatgtctctatgctgagaagagaaggtgtgcttgccagaattgtcagattaatttttagaaagagacagaggtaagcactgtgcttcgttttcttttaaacagggatgaatgcctcctttactggccctaccttctcagctgtcattaaaatataacccagtagtgtctagggactgtgtctctgggaggtgtgaccttcatttgcatgataaatcccagtgcattccattagcaatagaggggagggataggtatgagggggtgattcttacagaagaaattttgtctagagctggaaagaggagtagccctagttgaatggatcaagggccagagacaaggattctgaaaattctaacgtaaagtcccaaaagataggaattggagcttttatctcaaatcaaccttagcagatttaggagataacctcttcggatgtagagatgtgttcctttggacaggtagagacaaccctcacttctgggagagtttctcattttgtagtggcgaatgagccctagtggcagtgggtggacttcaaaggcagcacactagttagacctggggctgctgctgatcaagtgaaacatgaggttagacggaaaggctgtccaaggctgccatgctgttagcagacaatgacaacaaaaatagctgctacttgtggagttctcattaggtactaagcacttaactaccattttctccagttttttctacaaccctgtaaggtagacattatcatttctatttcacagaagagaaaagtgaggttcatggaggttaagtaatttgctcaagtcatacaactggcaagagaaagaatcagactttgaaacaacaccaaagactgtgtttggcctccttccaggtagaactaaaggagttatgttccagtggaggacagatgaccatacccacgagacagtcaacagacactggcagggaccagtgccatagttcctgggaccaaacatggcaaggcccagaatccaaggaccaaatcaaattatctttaagaatccttcttgagaaactctaatgggcagataccgacacattttggctaccataatctgacttctgcaggatgatgtctgctcccttctcttccagctaaatgcacacgcacagtagttccaggaggcctacgaggaaacctttcccgtgcttcttgatgggactctcaggcaagagtaaaacaatcatctcacactgctgaacaccaacccgacacttgggctcttccagcttgaagcattcttgtcataagggtcacagaaaaggaaacatcgaaggtcagtgcttcattatgtgagtgattttgagggaaagggagagaagcaagagagaaaaccttgaacaagaaagaagccaaagattcaaaaagaaaagcaggaatggttaagtacaaaatcgagaaggaaaggaactggtgtaagaacaatctgaatggagagcatgagattcctattcctctgcaatattgcaggtagttgcatgcacagacatttttcactacctaaatctgtcttcttcctgtgtttagacaatgatagcatagatagcaagagttggagagcaagagataggacattctctgaacagcacataagagagtgtagaccaagggagactcctttcatcccagcagcccaatctaagtaatttatctgaatccatatcattcctgagtacagagagctcaagttcacacagtaaggagtaactgtactttgtgattccaggttccactgtacctgcataagctatgggcatatatgttgtgttactataagtttcttatatcaggccacttgaatgactttataaataagaaatcctgtcttcagtatggcacaagcatagctttaaaaaaattgcaaagaaaaacagaaatccaaggcaattttgaagaatttcctccaagaatgactgacttgggtctttctccagacatactaatattagtattttactccagcttctcatcaatttacatgggtttacttcaatcccaagggaactgtggggccatccccacaccatggagcaagatataagaggaacatacatcagacaggagaatcacttaaaaaagtgataaagagacagaatttaggcttcttaaagataaagaatggctagcctgccctgggagttttctagaaaactcaagatatgacagatgtggccgacatatttggaagagaccaggaaaggtctgccagaggctgcttttcaaaagaaaggaacaaaaatagtggaagctctatctccctctacctcccctgtctggtgctccgaatgtacccacaacccaactgaaatcttaagttaaatttccaccggaaataaaaggtctaagtgggaatggggacaatgttgctgatttggcaatgtgagcagcaatgtcatgacacttcagtgctttatgatataacgtgttagcatggcagtattcgtcatatactggccataaataggtaaaacgtgaatggtttacatcattagagaagaaaatataatttgcgcacatatacctatttcctgcagtatgaaaagagtaatgtactcttctgagggaggggacgggaattaaagactcaccaataattctttctatgtgtgtgcctttatggttttttgacatgtattttacgttttccttccagagattctttgtaacgtgagattccttaaaagtgctacttcctactaacagtagtcaccaacattaaaactccatatcatgttaaattggattactgagttctaattttaccttaaatggagcagaggggggtgtaacattttttaagccacagcaagaaatccatgggatagctgcaaccgtttttaaatactcatatttttgtatgagtattaggcctgtctgtgacaatgttcttggaaaaaattaaaaagctcccttcctccaataatatgctcaacatcctcttttgccagaggcactcactcattatataaatcaaacaagcacacagcactagacaaaaagtgactagtaatgcccagcacattcctctgcttgagctgagatgattttggtgcattgcatgcagatgtcaggtattttaataaagagctccattgtgcaggccccactactcctccttagctcccagcactccctgaaaaggggggcaggaggagaggggaagagcaacagccattccagctggagctggaacctagtctgagtcaggaaaaccacagctcataagcaaagaggaagcataatgttctacaaggacaaaacattagcagaaatgtcactcagccccagttccacatgttggctgccacggcctcttcctcctagcatgcccgattgatataaattccatctgctcagcagccaagtgacagagaagaaataccggcatctggtctccattgctgtcgggtttttgttccatgtaagaccttagctagagacatatgaagagatgaaggtgctggcaagcgactaaaaggctgaactggcaaaaggagactttctgatgcttttcacacttctctttagattttttacagggatgggggagggtgtgactgagacttgataacctgaacagtgggagccaagaggcctgaaggtcatttcgtgttttttaaggtttgaagctttttaaaagagttttaatgttaaaaacgataaagcacaacacttattccccctttccatccatttaatgcaacagaaggcaactaagtcacagaagaatgttcttcagctattttttcccccttctcttaaacatccaccgatttggacctgctccacaggcactttatattctcctgaggagcagctgaaaaatgccaaaaatcaaaaccaccactctgttttaacccccagctgtccagaaaagtataaagtcatctatcaagcctaaaaccatgatgggaaagaaaagccagtctaagcctcataaagaaagctggatgctccaagagttcactcccaccaatctctcaggtcatcatttaattattcactcaatcagaagactgagaacagtgaaaatgaaacatggaagcagaactggtgagagaaaacacaggtatcgagtttcagtgtctattcgtgtgttttcaaagcggtatcaatgaaaatggctctgttcacaaacataacacggaaagggtttttaaaataaaacaactggccggacgcggtggctcacacctgtaatcccagcactttgggaggccgaggtgggtggatcatgaagtcaggagatggagaccatcctggctaacacgatgaaaccctgtctctactaaaaacacaaaaaattagccgggcagggtggcaggcgcctgtggtcccagctacttgggaggctaaggcaggagaatggcatgaacccgggaggcggagcttgcagtgagccgagatagcgccactgcactccagcctggacgaaatagcaagaccccgtctcaaaacaaaaaaaaaaaacaaaacaaaaaaaaacaattaatgtcaggtcctaacgctgccttgaaaaacaactgtgaaggtgaatcttgttaaaccctcttcaaagtatgactaaagagaagaaaggtataaactttctggaaaaagaatacaaaaaaagattaaaagaatcttttggcccagcgcggtggctcacacctataatcccaacaccagaggccgaggcgggcggatcacctgaggtcaatagttcgagaccagcctggccaacatggtgaaaccctgtctctactaaaaatacaaaaaattagccaggcatggtggcagacgcctgtaatcccagctacttgggaggctgaggcaggagaatcgcttgaacccaggaggcagagattgcagtgaactgagatcgtccaggaggcagagattgcagtgagctgagattgtgctactgcactccagcctggacaacaattccatctcaaaaaagaatattttaataactgttctattttacaactctaacagattttagcttcacccaaaaaaacaaaacaccaccatatgagattatgctgtgaaataagctgcttcttcaatctccaccttttcctctttactacctaatgagcacttggggtgagaacaccatgcatggtaaaagaagcgaattataataaagacaaaaaagttaaataaaatgacaaggaaaccagtagcaacagagttgactgtgacccctttgaaactgctaccagtgttaatgactgatgaaactgtaatgaagtacagtatgagctactagtagacaccagatttaacctgagagtgaatggggcttcagctcaggtctctcatttgcctaggtcgttaggagtttcagagtaagagaacatcctaggtggtaaggagacgccagagtgcaaacaggcaagatttctaggtaagcacttctgacaagttccctaaggaaatttagaaggaaagggcccaaatctccttgattcctgtttccatttcctgtttttttttggggggtgatttcttattctaaatacacattcaggattatacctaaaaatattaggagcttaaattagtctatttgctaaataggactctgatgttcctatgtataataatctactgaacatgtttaacatactctgtgtaaataaatgtcattaaaataacaatacagtggaagaaaaaatagatgaatgaaaaatcttattaataataagctctatacaacaacatttattaccttaagaaaataacaatcctggctgaaaaattttattcagtaagactgaaattcaggccagatgcagtggctcatgccagcaatcccagcactttgggaggccaaggcaggaagatcatttgaggccaggagttcaagaccagcctgggcaacatagtttgaccctgtctctacaaaaaatacaaaaattagctgggtgtggtggcaccacctgcagtcctagccactcagaaggctaaggtgggaggatcacttgagcctgaaaggtcaaagctgcagtgagctgtgatagcgccactgcactccagctgggtgacagacagagacccggagtgggggagggggggggaaggagattgaaattcactgaatacaattactacataaaatactagtagataacattgataactagataacattaactagttcacattgttttaaggacttgaagatctttctaagccagactcaagaatcaaaagtcaatcaaaaggtaataaaaccacacaaaacttaaaaaaagaaaaccaactacgcaacaaaaacaaatgaaaagcaaaagcaaaaacaaggtaaagagctgaaaaccaactatgaacaactattcacaatacagatatactatgggctaatactctttagatacaaaaaggtgctaaaaatgaaacggatttacaacgcaatagaaatatagaaagaacctgaaaagacgtttagaaaaaaaatggaaacagaaatgactgataatcataaaaggatggtaaaccttactcattaagagaaatgcaaataaaagcaatgtactaccatttatcccctatcaacaaccagaataccaaagatcaaaaatatgtttcatcacctagtctaccagtgtatgaaggaataggcacacaaattacgatacatccatacaatgcagctgttaaaaaagaatgaggtagctctttatgtgctgatatgaagttgtttacaagatatattattaagtgaaaaaggaaaagtgcagaataatgtgctcactatattccccttcaccatttttatcaaacacacagaaagatatgttgtgttttacatgcacagactatttctagaactataccccaatatcacttactttcaaccacagtcctttatataatttttttttgctaaaggcatgtattcctttttagaatacattttaactttaaaagtgtatttgatacagcacaatcaagagtctatccttgaacttatgactaaatactttttgtttcttattttatcattctatctactagatactgtatataagttcctacagacataacctgtcctgatctttataaaggtaaactaaaatgcttcatcctgggtttttgtttttgttctccctaaaatgctaagtttcttactctttttggtcttttcagatcactgttgtatttaattatatataaaggaacacatacatacacatatatgtatgtatatgtggcatatgcgtacatctgtgtggcaaagaatatggtatttttctgggtattaaaaatgtgatcatttgctaactccttacacccagtgagataaggataacaaagatcgtttacgaggtaaattcctttccaaatgaaaaccaaaccaacataatacctaactgatttacctccttggaggatttatttttaaaaacataatgtgtgtccaccaatgctgggattacttcccaacatagtttaatgcttttttttttttttttttttttttttgccttgtgattcaccttactctcggccatttcctgagccacgtctgaagaaatcctgtactgccaagatatatcctcagacaaagaaatgtccattagtcactcactaaaagggtaaaaagcaatcgaaatgttttcctatctgaacccctggtgccagcacagtatacagtagacaatatatgccataatttattgcctgaactccccattgatatgaccatgatatgtcaatggaaagtgagttcataaaaaataaattctcattctcttcacataaatttattgagattctatgacactcccagaacgtggatatagcaaacaacactatgtaccatccatgaaaaaacttacaatccagtaggagaaaaagacaagtaaacaagcagttattgtagagcataataagaaataaacgaaaactgccatatgggcattttagttggtacagtcaatgccaaatagagagagcagtagcagtttcctgaaaaagtgatggctaggttgagacctaaatgcaggtaggaattaatttggggaagtgttggaagcagcacacttcaggaacagagagaggaagagaggaagcaagagagcacatgtccaaacagaggaatgacacactgctaaaggacaaggactggggggcagttcacatcttccgcatgatagctactggcttctcattcttaagcttcagaaacaggcagaatgccatacctgacagattcactaacctgatcaaacacatcaactcttagtttgcaaacatcagaggatgatgatgatgccatgataattaggtgcaaagagataattagcatcaaagagacaggaaagtttatttgctgttggtcatcttcaccacccatcttatctcccccagacccctgtctacccctgtggcactgttttgcggtctaaatgggagtcttatcatctattgttcaaaatgtaatgccacctttatcaaactgtacgaagtgttcagctgcctgcttgtgaagcccaccaacacaacttcctacaagtatatggctgctggggtgactgaggagctgaaagaacctgcataagcttcaatagcaggccagagcaccacttttctgtgaacgacaactgataggtcaaatcactagggagcggctaaagagttattaatggtgacaggtacactacctgggagacaggttgagaggcaaaaaagattatttataagcgaatagttaacagctgtacctactgctaagcattacacggatgccacaaactgtagaattcaaatcctgagttattcaagcacgaacaactgcctgtcacccaaatgcaacgcatcgctacaaattaaggtgggagagatgagatgctgcaacgctgcctcacccaggaaggcaatgtcatcctggagctcaggtaagaggtggaaaaaggatgagataaccatgaggtaaattacggttcttaacaataatgatgaatttgcaagaacagctttataatttttcctgagggctttaacaacagaacagatgccaaatgcatcttgtattatcaacagtaaaatggacttggaagtgaggaaagattgaagagctgtggggttagaatgacaaaatgagaagaaaaatcatgacaaagaaacgatagaggtttggtctttacaattttgaataattattacttaagataattgttactaacaaactccattaataatatatgacttattttctaaaatgacaatagttcttgaatataactttttctcttattttttcttgtcatctctttaacagctcttgtttcatggtgggaaaacaataggtatgtcacagaaattttcagttcctagagaaacgaaaatacaaaaacttgttgaggatatttattctcatagattttcaactcagtatatattgagctttcaggcttttcagaacactgagttgagaggaacaacttccactgttgattttctaaatgttaatatatgagatggtttctatagttatctactttgtttatggtccagagtcatgatagagtagcataaatattcctatcaaagtggcagatgtcatatttacccaaaatacaatagttttagaagtacctacataatgacctggcaattctacttctaaatatttattctacaaaaacaaacatacacagtaataaacacatataaggatatttcctacaacagtgtttgaaaagcccaaacactgaaaacaacccaactgtctttaaataagtgactaaataaattatggtatatccacataatgggaaattatatggaggttcaaaaaatggatgagatctctctatactaacgtggaaagaggcctgtattagtttcctagggctgccacaccaaattactaccaccgtagtggcttataacaatggaaacatattctctctctgttccagaggccagaagtttgcaattgaggtgtgagtagggctgtgttccactcagaggctctgggaaataatctgttgcatgcctctctcctagcttccggaggctctgccgccatctttacctcacctcctcctttgcatatgtcttctgctctgtatgtaatctcctaatatcttacacggatacacaggatggtagttagggcctacccacagagtccgagattatctccttatcttaaaatccttgacttaatcacatctgcaaaaacccttttttccaaataaggtaccattcacaggctccagggatttgacatggatattttgagtggaagtgggtagatattttttggtcaaccacaagatatattttttaaacagtaggatataagaaaaatatacatagaatgaatccatttactaataatcataattagtgccacagatacatgataatgataacatatggagaagtgttatctctacaaaaaggggctatggacagttttcatttttgcattatacattactgcaatgtttcaattttatattaattttgtattactttcataatcaaaaaccaataacacatatttaaaaggaagctttgatatattttgacatcttcccaaattttcttacctaattctggtccctgttgtggaaaaagggtttagtcaaaactgcataatagatgatgattactagttgttctagtggaataaaattttataaataataaaaatattaagtcataatttttgagtatgctattcattaaatagactgctgtagtttctaaggatgaaaagtttcatccttaatccaaccttctatgaatacctgacaactgttccactaaataaatccccaaaccgaaatctatgacctctccttcaaaactgaggttttagttttattttttatttatttatgagatggagtctcactctgttgtccaggctggagagcagtggcatgatcgcggctcaccacaacctctgcctcccaggctcaaccgattcttctgcctcagcttctgagtagctgggattacaggtacggaccaccatgcccagctaatttttgtatttttagtagagatggggtttcactttcatcatgttggccagtctggtcttgaactgctgacttcaagtggtctgcctacttcggcctcccaaagtgcatgagccaccgcacctggccaaaaaagtgaagtgttttttgttttttgtttttttttttaaaaaagcctttctaaggttgactatgcacaggcatgaactactgaagcggcattactgttcaccctgccctttacgaaattcctctctttgcagattttctccctgaatatagcttcatcttcaagttttattatacctgcaaaatttagttaacaacaacttcaccttattaacatcttctggaacaaaagttccagaaatcactgtacatttctctactccacatttcacccccttcatgagaattgctaagcactatgaaagccaattggggttccctggattttctctctcataaaaaaactgacaaggcttttctctgtctaggagagagggcgatgatcaagatccacttttatggaaaacatgatattatgctgagaaatctgtcaagagcgggaaaagcacttcatagagggagaatgtaaaccataatgctgagagaaatatctgcattaactttttgcatttgttcacaaaagtttatgaaatgcctactgtgtgaaagattgcaccacaaaccatggtatatgttgtaagctgtgtgggcagaacttctggtgtctgagaatctgacaagaagagaaatgagttcactaacggcagactgttgctctgacgcacggccagccagcaagccgaggcatgaggagatgcaggggaagagcatgagctggacaggtgtcatgcacaagcagctctgcagcagggctcacggtgcctgataattatggatattgtcagatctgccaagagacatatttagcaatgagccgggagggggcaggaggaggtaggcatattacgaaacttgccacccacctcccattggcactatcagtttccaaggctctattaaagataaacaaggatgcctagcctcccctgagatcaagaggagatggtgattatgaaaataataacagttttaaaaattacttaaatgttctaagggagcctttatttctggcagtgttaaacacttgcaaggaagaaggtagaaaacaaaaacaaactagaagaccacagtagcctcagtctgaaaggccactccagggctacttaaaccaaacactctctgtgagttcagtggttaggcttttccctcctctgggtggcattccaaaggcttctccttcacatgtgcaaaaacaagaaagcggcgacaagatgctacagcagatttctgtttgagacgatgtttctgagggaataagaaaaaaaaaaacaaaaaaccaagcgagagagggagaagtttttctttcatttaattttttttttaaacaaaaacctagagacactggtctgtgaagccaagtttgttaacgtgcaagtataatttacttttatgtaaacataacttcacagagttatcagtaggttccattttcagtaaaaacaaacaaacaaaaaaaaagaagctgcaaaataattataaaacatatggtgcaaactccggctgtgtttattttatgacagttaacattatttacagtgtgatctggtcagaattaatactcaaagggttatacacagaatatgtcaaatttttcttcttaatcatgcacaccattagttttgtcaacccatctaaatgaatttatctagagatctcctgtattcccccaaagaaatcaattatattttttaacatattattttattcaaaatgcttgactaacaccaccgataagctgccaatagtaatataggaaggagctcaccctcttcttaaatggggaagtttgacaaaatgcacttaaaattctgccatttgttgcatgagattctttaactccacactgttcatttcgttatctcagttgctaacgcatattaaatttttaaagatttaagttcttttttttttggtaacaacacagctactactttctgttaacacataaattatcaatatatcctgttgagtaaaactatttaagtagcttatccttgatactggagtggcattaggaagcactgactataggatctgcttattattcaagtgggagatatacaacagccaagagacatacagaaaaaaaaaaataagaataattttgcaatgaaaatctttatttttgtaatctttgtaatgaaaatatttattttccctgtccttttattaaaagactctggtattttgctctcattcaaggccttatattaatataaataccaaaatttatgggaccaggtggtgtttagtaatgtgagctgaaacagaaaatggctgcttttcctccctgggcacgcagacacaagacatcctctcctacaatagacactgaccacaacctatcttcctattcaccagaaatggttttgtgcagtagtgtgctagggctggctcatgccagcctatgagagctgattgctaaacattcggaaattttgggagttggtggttcaaacagacgacattaaaaattaaattttagaaacatgcaatgaaaaaaattaaaaacaatgataataggtactcaaaattcatcacttctaattatttgacattttactattatctatgttcttataattatttgactacattttactattatctgtgctctgaagattacttgcttctacttacgtctggtatggtggaaataccatataataatgtgtgactaagcatctcttcccaactccatgttcagtgactcatgttgacaggctgaaatcagccatcatgggatattttcaccagagaaatcagcaaacacttgcaaatcagggttggctggttgcttggtttgttttcatttagaaagctattgtaatgctaccaacacaacgctagcaatgtctaaataataaattactgtctagtttcaaaacttaagactttatttgtaaatatacactcatttaaactttataatcccatctgtacccttgtgggaaaaagaagagaaagagataattttgctatgacagaaaaattaactataaattttatttggatcacttatttttatgaagtcttgtaaaacataacatggagcatgatttctggatatgaaaaacattagatatgacaaatgaaatatatggtttgtgtcttggacaggaaacaccctgcatgcctctggaaacaaacacaaagattaagtatcaggcacacaggtttttaatgcctagattattctgtttttataataaattagtaaatgagattctagccattacaaatctgtgtgttgttgaaaactgtcatttgatctatgataaaaatacaaataaggaataaagcataaaagagaaataattctgaatcaaagccaataaaaataagacagcttatagatattaaaatgtaagaaaaatttagggataagttacttttggttaaacatgtggcagtatctgttaagatgaaaatgaggatgaatcaaatattcatatttttaaaactaaacctaggtaggaagaaaaatctgcctatttgtatttcatggtacatccacaaactcattacttcaatctgtcgtttataaacttaaaacaaacattacatttttcaacattactgctatttgtaaatcacatataaaaaggaagcacaatgtaactaaatagcaaatgccaacaaggagataattaggcaggaaaaatatttctgagttaaaatgtatgtttttataggtcttcctatagcagcaggcaaaattttatagaagtgaattttattagagagaaacataatctaaaaatcaacttttaagacaatcattcttagtagtaatacagcagatttcaatgtaactacaaaaaacgtctgacttctaaaattcgtttttaaaaacatccacgtctacctaacactggtagactttgtgaccatcagctaaaccaataatggtgtaagtgctttttaaaatagtcctatcctgaatgaattactactgttatgatttaaagagaaatattactcaatgcaaagagctctagatgtgatattagaagatgcaattttgaggattactagttttggcactgttaagctttcttaccattatcaattatggttttcttcctcgatctaacattgtggaagtctccctgttttagttttacagtaaataagactgcccgtgaaggagagaatcacacaatagtaatgcaggaatggacatctaactgtgcaacctaattctgatttgtaccatggttgcaaaaccacatcataaaaaatcatgagaaaatcatttctaaaaatctgtgtctctcttcctccttcattaccctttcccttaatccgtctctctaaactgacataatataaaattgaaatacattgtcatttatcatacttaatagtttatgtaccctgatcttaatttaaattataaattgcatgtttgtcttctggaaacaaataatgcactaagttgctttctccccaagtatctctctttatcgtcttttgtaggtaggtatactctttaacaaaaaaatgattctccacccatctataagaagtacagagaaaccatgaacaaactagttttctatttactcagcaggaagatggcttttgtatattttcataaataacctagatatgatttctttaaaaaacattcacagtttggaggagtttaacctagatgacaaagtaaatggcagaaaaaatcaaaacttttatactttggctctgaaacgtaactaaatagcaaaccattcaaaaatcctaatcttttggttaaacatgtagcagtatctgttaagatgaaaatgtggatgaatcaaatattcatattcttaaaattaaatctaggtggaaagaaaaatctgcctatttttttctgtagatctgtagataataaaatgatttccaaatttttaacttttgtcacaattgacatttctacatataaaaataatcttcatcacctataaaactaagtttccaaaaatcctaggtagctgctcagttcagagaaatgaaactaggaaatccaaacttttgggtttattgtttatggcaacgttgcccatatgtttttaaaagatgggagaaaacacttggtgtcatttacacatctttgcaaggctgatggtaaagaaagcactggcgtaatttttaagcaacagtttcaaaaaaggaatttcatagattccatctctttcatattaatacttctggacagaggaatagaaattgtttaggaagttgcatgaatgtcctatgttcactataaacatagttaggtctacaaccttaccagtttcctagattcccatatacccaatcttgaagcctggaatcaacctatgagcacctttttttctccctcatctagtgcatctagtcagcaagtagttgtatctaaccctgctgtttatcctccctgccattactcttaaatgccagccttatgtctgcttgaactacagtgacagctttcaagccagacatcctggctcaggactccttagttccacatagataccactaccaaatgaagcttcctaagacactaaatcaggtgagtaaagattacagtactggtccccaaattgctcatgtctttggtatccatgtcctggagtagtcatctgccactgcagctctgggctttgtaatgtgactggctttggctgatggcatgctagcaaatatgaagcaagtagacactttagaagtgcctgcacacttggacttgccctctcctgctgcccttaagaaccctacaactatctgcaggtgaacaagcccaaattaacctgctgaaggacgcatgataaattgcccagttatctccactgccccaaccaacagccagtaacaacctaatagccagatatgtaaatgggccatcctagaccaaccaaccccaggtcaacatgccagctcactgcagatatgcccagctgacccacagacttgtgaaaaataataaaatgctgggaatttaaaccactattaatatactaatatatgctttactcactttaaaaaaaaatcagctttcagtgaaatgaaactctttaaactaataataaacgcccttggtgctctggttcttgtatacctttctatacctcatccaaatcttttatagacaattctatatttcagaatggactttgttaaaggcatgcaacattgtggaaaaattaaaaatgctaactaaatttaataaaagtggtctaaaataccctatgtggtctttcttgttgtgaagttcagcaaaattcttttctgtagaaggtctcaaaagtcaatcactaataagctgaggtatgtgagtttttattctatctaaatgtatttctagcctcacaatttaagactcacaaaaacacagccttttgtttttatttttttccctttcttttcataaattggacagcctgtttgacatggagaaaaaaaattccccttctccttcagtcttgtatttaagccctgtctacaataactgtaacattaaataaagctttgtatatatatcccataaatatttcatagaattctaactcaagctaataatgtactttaaatgaaaagagaaaatataataatctttcagatgaatcttcgtatttttgctctttcttccaaagatatattttggaaggaaataagagaaaattatgggaacattatctaagccaaattttagtttctgtcctaaaccaaatttctataaacaaaagcagtttttattacctgtttgttttactcatgaactgtatgctcctcaaggttagttcggctatatagaggcaattccttccatttagtatattacttttatcaaaactaaatatttgaaatgttactaacatattagcatctataaatctcactactatcctgctcataaaccctataaagtgaaaattatatggcatattgtagagctcatcctaagcagaaaaatattcctgaaacatgtctagaagctccagatttaacataattatttaggtttttcaactaccctggatagaagatgtctataccatttatacatttattctgcaggaaaatatgctttaattttctgaatgtcatttcaaagtgaatacacctctttaggactatcttttgatgtacactgtaaaagtctggtgttatgaaatgcatgagtacatacggtttccttgaatcgcactcgaaacactatagtattatttgaaaaatcttttaaaagtattcttaaaaaccacatattactcttttagaaatattattgctgtaaaaaaaagtggacaacaaaaaaagaaccacatatcctcccaagccctcctcaatagttatgtaatatttaccaagtgaaaatgatcacaaaatatatatatcaaaaatgaaagaaagaacactgtagaaaaataatgcttaccttttccaccacaatggtatttaaattctaccatcttgactttctattaatataaaataacacatgtaggagaaggtagatgtatctttcataaacccaatgcaacaattttaacaaaagccaaaccttgactaaaataaatggcaaccagactcatagcaaggcatatttgacctgtggcataggcaaatctaaaaagtttgtgaaatttaaactatcagacactccttaggtctaggaaaccacaacttatgctcaggatgctgtttgggccttcaaagcaatatgctcaagtgaataaatcatacgtgaaaaccctatactatagcattcttttataaagttcctttttaagaagtgttctccttctaagggtgtgcccctttcaggtcccagatacttttccatatgggaaatgtaatacagtaaagcttccttccatctggtgccttgaaaaacatttatgaagaagtttacatctttgataattttgatactccagacgtctctttgtcaaagttatcctaaaatatgaaccttagcaatcataatttatattaacagcctggatccaggtgtaaggtagaacagaggaaagagaagacaaagcagatggtactgcctgaaggttcttctcactgtcctaccaattggacactgcttttcagaagaacctactggcactagactatcaccttcttaattatatacatatattacttatcagtcaagctatcagatgaactaaaattctatgtactgagtgaaggaaactaacaaagggaatacagactaattctaaatctggtactctactttaacaggcaccacaacttaatataaaacatctacattttaattggcccaattactccccacgtggcactggcaacagcaattccacagagatcgtctcgttctaaatgagtgacttcacaggcagtttttctaaaatgatcctgatggggctaaaaatgatcatctttgatttctcactaaaaggaaattttaaaataagttttcattaacttgtcgaaacattttaaggaatgggaaggaaatatatcttttgctgcttaccttctataatctaataaataagtgggttttccataatggacagcaaaatctcagtaactgaaactaatataaatgtttttaattcaaaaagtgggggccaggttgaaatttacgttagtcagtcatttaattgcagagtttgaattaatattattaaaatacaaccaagacagttgaaaaatgtttaaaattccttaaagcattgacttttcaagtaaattggtagtatgtccaaagagtctatttacatataattaatgactgcaataattatagatcatacttacgttttcattagaaaacatacccagtgatctcccctttcccttaatttagcctgagtcaccaacttccactaaactgaaagctgtaacagaggggcatggtgtctgtctgtttaccacttgtaatataccatggtgtgtgtgtgtttaccacttataatataccacttccactaaattgaaagctgtaacagaggggcatgttgtctgtctgtttactacttgtaatataccagttatctcttgaataaatacattttcctgaatcctcaaaacagggggaaaaaaacaaatagaatatttgtggggaaaaataaatacgactgggcgtgttggctcacgtctgtaacccctaaccccaacactttggcaggccaaggtgggcagatggcttgaggtcaggagtttgagaccagcctgggcaatacgataaaatcccatttctacaaaaaattaaaaagtgaaaaaaatagccaggtgtggtggcacacacctatagtcacagctgctcgggaggctgaggtgggaggatgacttgagccagggaggtggaggctgtactgagccaagatcattccactgcactccagcctgggcaacagagggagagagggatggagagagagaggaagagagggagagagggggagggggagagagagagagacagagaagggagggagggagcgagggagggagagagagagagaagggagggagggagcgagggagggagagagagagagaagggagggagggagggagggaggaaggaaggaagggagaaaggaagggaggaaggaaggaaggggaaggaaaagagggaaagggaagggaagggaaggaaaggaaaggaaaagaaaggaaaggaaaggaaaggaaaggaaaggaaaggaaaggaaaggaaaggaaaggaaaggaagggaagggaagggaagggaaaggaaagcaaaggaaaggaaaaggaaaggaaaatctgtgacctaattggaattttgaaaaggaatagaggatcatattttaaagactacacactaaataaacagaatatatcaaattatatatcttaaattagcagtaatgagtagcaaacttctattcaccacctgtaacttttctagatgcacctcccaaagttttaaccagatgtctcaattcatttttattaaaaattaacatgcatagtaaaaaaaagacaattttctttctgtatctgacccccgcaaccatgcaactatttaacgtgatttttttttttttttttttttttggtaactgcaagacacaacccagggtaaccagaagttactgtgaaattctcaaacttgcaaaagaagcaaatatctgcatataaaaattttgtttcaggagaatactagggggaatttagactggagaaacatttccacttgtgtattgaaaagaataaaatcattatttaaacactctaagcttcaaactttccattaatccaaactgacctacttattaactcaaaatgctagtgttttctcctatcatatacgtcaatacgcatattacaatggttgggcacatgagtatagggtctctatatctaaaactttgacttaaagttaaccaactatttctcaaatccttaaaataatttttgtggataatttttcaatagccttataaggcatacaagcataactggctacaaaaaagtgtatatgtaaagggagttaatggccttgcttaattaaaatgtaaaacttcagcatcttaaattccatttatgtgattttaaaggaggcttcagtaagtcgctcttttgacaggagcattcagattgcagagaaggctacaaaggcgctaatgacatttacccccctaataagagctgttcacacttcatggtttttccttgttattgctcaggacagacactagcacctcattgaaagatcagtgctgcaagggaaaaaggccccctgagacatctcagacctgaggaaaagcactaaatcaggtgatgctacaaagatgacatgtttgattctccagggttcttactcgccctatggccatggatttgaggcagttaacacacagccaatcaaaaccctcccctactcccagaagacagggccatcctcttctgcagcaggcatagtaaaggctagagagaaaagaaataaacttccttcaggtgccctaggtctggcaggatccaaatgtcttgtactgctctcagttaatctccatcgatgtgtggctgaatgaataacacactgaccttttcacctaagagaccacaatttgaatccaacggaaagtcaccagagaatcaatggacagaggcactcatattttaaagcaataaagcactgcaagaaaggaaagggggaaaaagttttttaccacggttttggccacagattcaacccggtttccctggctcagctattatgaattggaaccctgattcagaattgaaaagctcccagaactgcctctatggatctcaaaatctggcacaagcccatggctactgcaagacagacattccctcacatgtcaatacgtggaaaagcagaaaagcaatccctgctggtgatggaatgatggctgactcaatggaatatactcagcaggaactctaattctggcagagatgacagcacagagacaagtagctcttaattactctttccaggggaatttaagtgtattttgttgttgttaattcaaaatttctcaatgtgtgtgcatgcttaaaaagaggcaaatgaatgcagcaatttaaggtgcttccctggttacctaattttcttatcaacacatcataaaataaacagacttcatattaacagactctctagagacaaaacctatgggatactctattgtcagtttctctgaggaagcctgacctaccatgaccataaaccaatattgtcactgatctgtgttccaaacattctcctatttatcctactaaggaatctgaaaaaaaatgcctattgtgcacagagccttccttcaaaattgcatctcagagaagatgcaatatacgccagtcttcaaataaccacatttactcaactgctgtttttaaaatcaagaaagaaaaaaaaatccacagcaggaaaagcacattaaaataaaaatagaaaatacagtaaccacattactcacactaactagaaagctgcctctgacactattattatggctttaagagagaaaattacatgagaacaaggaaatcaggttaacacatttccttacagagagaacctttggttctcaaagtctttgaaaaatgcttttctgggggctaatgtaagaaatacacagaaaaatgacgatgagttcgagcagaaaatacatcccagacaatgtttcactctcttatttggggggcctcatgtattatgatctactatagccatgcaagtcccctatctcaagtctaccttgactgaaaaaaagagagaaagaaaagagagagaagaagatgggggaggggacagggagagaggaaaagtagacataacagatcactcagttgccaccaacaaatgaaaaaacttcctagataccaacaggaccacaatggtaggtttctaaaacaattgttcatgcatcactagctagttagccacatctttaaaatctaaggctatcggcaacaaatgccaagtttgtaaacaatcagaatcactagtgacttccctaagaaagaagtgtatgcaaacatcagacaaatcaagaagagcttcagatcatcaggcctagatgtggcctaaccatgcatggtcactcattctcctagcaaagtattggcccacattttgttttacacttccgtcagcattacatacaggtatcatgaagaaatcaaataaatgtatctttatttgcatttgtcccatctgtatgaatttagcaaaagcttccagaaacccacacagatccttatctcattttctacttttcacagcccttcaagatttcatacaccagcacttgaagtaagtcactcaaaagaaacagatagtagactaagactcagccttgagagttttctcatgactcttcattatagtcacagaggatttcattcctgtacaagtccccctcatcttccactgggctattctgtcaaattgggggaaatactagaaaaggacacagtagctcaaataaaacgtatgggcaactggaagactcataaagctcccgttgctctagaaacttaagggttggggtggggggactaggagatcattctacttcaggaattaaatttactaagctccactatgaatttaacatattacttctcttcatcctgaaagctcctttaagaaggcaccatcaagaaaatacggctcatagaaattttgtgctttttgtatggctagagagttaattggtgctagaattaaggtttaaacccaaagctcagagctttccactttaaattcaacaagaaggatgtatgagtgctgctcaggagatcatatgatttaatcagtgccatcacagacaatgtccatttcaagtaaatctgaactgattcttatcaaatggagactggccagtgagctgtggactcatttctgctcctcctgggggaatgcaaaagcctcttcatgtcccacaggcgcaaatcctattccggcagtcactgcattccatcctggaatctggtaagccatatatttttattttgcaagagtaaagggaggaatattttcattttaactctgagcacaaaacatcaagctttgtccttggatctaaggtgtttattttcattgccgttcaaatagttagagctttggcatgggattcaaaatccctgtattccacttccagctttgcctctgcctgaggcctccccatcacggtaactttaaaaccaaggataatagtctctgaaactatctctctaatagggaggttaggaggcttgccaggacagtgtttgtagagtggtccaagcactttagaaaacagacactataaatacaacacactgctctgaatcatctattttttgtatatccctgccaaagacagggggatcctgaccaatcatacatgtgatccttctttcctgaaaaagaatcacatattggtgacataatgcagcgacaccttccttatgtcatggtgttgataatccaatctttacttggtatcaaataatcccccctttatgtcaattttctgggtgatctgaatatttttgtagtttatataatacaactttccatcatttgtttagagctcaccgattagagtgctggttttctgagagatctcctatctcaatatataccaataaatcaattttttttgctatttgaaggattacctaaattaatttatatctagattcattgatctttctgctccagaaatttcctaaaaacctgtgaggtcagataatacctatttcaaaggctgttttaaatgttttattttatgcgataaggtgcaatcctagatactctaatcatttaaacaaatatatcaagtaatcattcattctgtgccagagcttggaaagtattggaagagttgataaaatagggaaatataaaggtgataaaaatgacagtgtcatatatagaataaaccattacttggccgggtgcagtggctcatgcctgtaatcccagcattttgggaggccgaggtgagtggttcacttgaggtcaggagtttgagaccagcctggccaacactggtaaaaccccatctccactaaaaatacaaaaattagctaggtgtgctggcagacacctgtaatttaggaggctgaggcaggagaatcacccgaatccaggagatgggggttgcagtgagccgagatcatgtcactgcactccagcctgggagacagagtgagactccacctcaaaaaaaaaaaaaaaagaataaaccattactttaaaaaatgcacacatgaaaatacacatcttcacaatgtagtaatgttaatattaataagagtactatgggctggttattgcactacatacttttaaaatattctttgatttaacctttatagatgaagaaactgatgttcaagtatgttctctctgctggctaacagagctaccaaaaagtgaaaccaagattcacaaccaagtctgtccaactctgaagtacaaagtctttgttactgcatactcctgcctcttatttatatccaagtacattcatatgtacatacatatatacgtgtgtatgtgtatgtattatttattgataattaaatagtagctgctctttttctctactggttagaaagggattcttctctaagaggtacagtgaaatccaggatttaaggctactttatagaaacaaagttctaaaatcatcaggttggcagtagtctgtaacagtctgtatcatcatctttttcactatcatattaatagttagcattgcctggatacttagcaagtggtactactaagtgctttctgtgaatcattctactttgtcttcacatcaaagccatgagtactattattatccctgttttacaggtgagtgaactgaggtgaataaagacacgggcctaattttttcacacatctagtaagacctgaagccaggatgcaagcccatgaatctgccttcactgcatgactctgctgcattaagcttttctggtccaactctataaaaagaaggcataattatagctattccaccacacatgagtggagcacagacctgtactcattttccctgagagtacctgccaagcccatacatcctggctcctcctctcagtcacatggcctcatttacaaatcagttctggtcagtgatgggagaataagcaccctactacacttctgagccacatccatgaaaatatcccacagagaaccttcatcttctctcagggttgccacctggatgaggaatctacgatccgagaaaatggcagagccataaaacagcaatagccctaaattacctcttgtcaaatcacttatggaaggaaagcattcaccactagactaggcttgcagagaaaagagaaacttctgctgtgttatgccactagtagtatttcaggatgtacttactaaaacaactgcaatttatcttattgatactaacgcctaaaatgcattccctatttttttaaacatttggcattggtagagaaacatgtttagcaactgatatttctctgttataattactcagagttaactttacacatagatataagtgaaaaaatgccaatttattgagaaggagttcacaacatacatttcatctatattatttcatctttttagacactcaaaggtagagacatgaaggttatcttaattttagagaggtatggggagttatcttaattgtaaagattaagaaactatgactaagaatggcaaagtcttccagatttaacccaatcttgtctcaatatccagagcccttttgccatccaacttgaaatgcttttataaacccaggaaagactacttcatctctcttccaatccctgcacatggtatagctgaaatcttactaactaggtacaaaacctttgtttttatgctcaactacaaaaggtatgtatccctggaaaggccaagtcaaagaccggaatttacaataaagcattaaggataaataccagatctggttttagtcacagaaatgagagcgaatagaagtaaagataacaaaatggagtatcaggaaataggcaagaaaaggaacacgaaagaggaatccatttcacccaattttacctaaggtcagacatttggtgtgccactgaatatacgagatcttaagttagtctgtcagttccagactcaggcctcttctcttcccccaaatcatgccacactgcatctacagactctcacatattacattctggaaagacaggctggtagccttaaaaacaaaaaacaaacatccaaatattgcccatagagtcaaagacctgaattcaaatcaaacttcaaaacatcctccttccaatatttaatacacccttttatgtataagcctgggtgctggtgctgggaagcgagttacagtgatgaataagagacatgtgttatcttcaggaagcttacagtgtatcaactgtgccaattaacacttctgtgatcaggggaaagtcacttatttgagcctcaactataccaaatgttaattcattggcaacatctataagaggatggtgtaagaggaggaaaagaggtaacttacatgaacttgctccgcaaagagctgtttaaatacaagtgtttgcttaatatggatgttttctaccacatggataccataaaacacttactctacacagatcactagctagaaggcatgggagcctttacttttcttcttattgccctcaacagcccagctgctgctatagcagtcagtccttaggaagcctggagaaaaaactaagggccttttgacaaactgaagttactggttattccatgagttccatggtgaaacatcaagctataccaagctaaacaggtttccctagccattcacttaacaaatacttattcagtgctctgcatttgtgttgttccctagtgaggaggccagaaaaataaacattttaacagttgacttaattgactgattttaaattgtgataggagtttgaaggaaacagagtcctaagatatagctacactacaaaagacctacattggctaagatggtcctctgtaagaaagtgagactttggctgatgcctagaagagaagaaattacccacgcagagacacaagtaaggtattccaggcagaagaaaccttacatgcaaatagctcatgtgggagaagaactgagtgtgttcagaactaagtacttcaaatgagcttgaagggaagaggttatgaagtgggaagggttggagaaagctacttccctactcttacaggctcgtaccctagacctcctcagagcctgtgttatactaatgagtatcatgaaggttaagagaaagatccagtatgtagttactcccaaatctaaagctggacctctaaaagacggatggccccattcgtctttgagaaatgctcttctaatgtaccaattgtgctggtaagacacagaagagttgagaggggcatcaataccactcttcttataaggctgttgacatctcagctaaatattcagagtgtctcaactgcttctctgaattctggcaggacccacctgcaaatgagaagatttccacagacaggctggtggatgagcccaggcaagtcagttatacgttcaaactgaaagagactataaaaacttgatttttaaatgactaaattcaacaatgataatcacccgtattcttatttcctaggtcaaggacagaggggaaaatggggaaaggacaaaagagggggccactgcttccattcatggtcaataaatgtatcacaagatacagacctgaactaagaattcttcttcttcttcttcttcgtttttttttttttctttcgagatggagtctcgctgcaatgcccaggctggagtgcaatggtacaatcttggctcactgcaacctctgcttcccgggttcaaggaattctcccacctcagcttcccaagtagctgggttaacaggcacatgccaccatacccggctaatttttgtattttagtagagacagggtttcaccatattggccaggctggtctcaaactcctgacctcaagtgatctgcccgccttggcctccgaaagtgctgggattacaggcgtgagccaccacgcctggccagaattattctttagtagtagaaaaacatcatattctcccttgtatttagattttatcatctaattgcatattcccatttttgtggttttctggaaaatgcttaaaagctaactttctgtactttctgaataaatactttaataagtacacaggagaatattgggttcttaatatattacctgacttcttaagtagttgtagtccaagttatgttatgcattttatacccaactggctagcttgtgaattatatagacactcacataggtgaaaattaactttataaaaaaagtacaggatccttgaccgatgtgccagccttttaaatgtatctgtagcatcactatcatctccctttttctaataataacctcttaaaccacatacttttgaaagttctgctcccctcttccccctacatccaaaaattcaaaatcagatcagacaactgtcattcttccacatttaaaggtatctcagaaggcaggagtagctgtgtacacataaaggatgcaggctttgtcccacagagagttaaattaatatcctggcttgactagttcaacttaccgtacatcttcatttgcccaggaacacaatctgtagccaactgctaaccaagtcaatatgtggtaagactaacagccaccctaacctgccttgataattattctcctttaactgacataatattcaatatactgttgttgagagcaataatgctaaaattgatgccttgagggctacaagacaattgagttttagccagataaaatgacttgtacactaatagagcattatggggttccacagccttcggacacacattttatagcctacttttacaaaaacgccatatacaattatattcaaagtaatttgtgcacaccttatcattaccacatacaatctttaaaatattggccaattatcaagtaacattactttagaagaatgggtttacttttacagtctctctcttttttctttacaaaacaaagcattttctcactacaaaagtggtaacagttttggtgttctgggaccatttgcttttttttccaaaccgagaactgttttaacaaagaacaagtagattataaatgctgaatgacaaaaaccatcatttaaataaaatctatattacatcaattctaccaataaaacaagacagaaactaaacctagaactcctctaatgtaaaaatcatctatcgttttctcaaaatgtcaattttagactgaatggagaaatattatattaaatttgagactgtcaaaatctatattaaaataataaaaattaattataatttaagtattacaataaatgaaaatgctctctataagcagtatttcaccctaaaataagagatttataaattttagttcctggttttactgaattttcctctcaaatttcatttctcttgcaattttgtttctttaaatcaagcttgtccaacccacagcccacgggctgcatgtggcccatgaaggctctgaatgcggcccaacacaaatttgtaaactttcttaaaacattatgagagtttttttttaagctcatcagctattgttagtgttagtatattttatgtgtggcccaaaacaattcttcttccaatgtggcccaggaagccaaaagatttgacacccctgctaaatactgggccctcccatacaaagaaatacagagtacatttacattttttatacctgcattagagatatgttcacaagttggggaaaaactaacatctaaataattatttcaagtaaaataaaaaacaggcactggccaaggcagaacaataggaccataacacagaaacattatcaggctttatgtttactcctatcaaagtgctacctgagctttgttaaaatggcaaaccaacatagccctgcacatacctatttgtttggacagaaagatacaatgtatatgcttgtgtctctgcgtaggtatacaggtgtaagtatcttaggcaacacatacacatgaaactgaaatacaatattaatgacagaagtataagcagcatagtggaggtaataaagatggtaccagattggggcaaaacacttgttggtttggaataaagaaaggactgttagccaagctaacagttccatacaaacaactgtaagaggtttttctctttgtgtagggtaaaatccattcaaaacagacattaataatcacgctgtagaaatgactgtagaaagacgcagcactgtatgcatcttggggccagtataagcagggattgtgaaaccagttcctgatttatttttcctggccccttcctcctagatcttgttccccctcatgccccctgaccgtccaagacttatcttcctactttaacccactgaaatgtccccatcctgaggcaaatgagataatgcttgtaaacattctgtataaactgaaaacgtaatatataattgctactattatcaccatcatctcatcttttgagggccaaattttctgtgtcttcccagttgagattctcactaaattaagacgtcattctattctgagagcagacaggttattccaactcccttccctttccctacttctactttctatccttccactgctctcctgtcccagctaacagctggaggtaccacacaggaaaatgacaagaatctgtgtgttctgatgccaggttaaaacgagaggtagactgaggctccccactcctcacatgccaagctggcagctaatgcccttcatgtaacacacagtagctcagggaataaacagtggagatatgtctagcactatacaaggctggcacagccaaaaccaattgtttttgaaggggtcatgtctcctggtattatcctcatgggaaatttgaaaaattgcttcagattctaccttctcaaattgagatgtccttcggcgagaggggtatttcttcatcatccagtgtagcctctttggatcctgggatctcccaaaatgctgttctcaacattgacccctcaagggttacaggaagacagatagccataaacacatttcagaggcaaagtatacagtgcaaataacacatgacacattgcaaaaatgagatgaagaaagagagggatgggagatgggggtgcatgaaggctgtgggcctcccagaaaactcttagagcccttaccaggtcagaagtgccattgacacaaaggagacactcaaggctggaagaacaggttctgcaaagacgaaatctaaaatcatgtctgtgtgtttcagaaggtagaaatctgaaggctatcatgtgagggtttactggttatataagtttatatggattatagttctacctttgagttggctgaaaaaacaataaatagtaaaatgtgtacctttaggtacaaagacaaccaagaaaaacaccgtacctgcaaactgagtatgagaaaaagccctaataaacccaaatgaagggtaatctcagattttcacacacccattacccgcctcaaagagccctcctttttaatagggttataataagacttgttgaagaagccagaaagcccatgatgtagagaaagagttgaattcaaaaaggtgcaaacaaaggtaacgcaagtcaagaggccaagttttccttctaatacagcctgaggcccgatggtggcctgctttgtctctctcctttccccttccctgacaagcctgctgaaacgaccactttaaccagaggagggtgtgcagcccttcctgcgaggtttgtcaaggactctcacccttccccacccacagtcggccccggacacgggcggcgttcaagtcctctccctacctgaaggatgtatcctcggacatagtcccgcagagtccagccaaggccgtgcagtatgtgcagtacctcctcttgcttcaggacgctgaagagacggtccagcaggatctttagccgcacaggcactgcttgtgtcccatagagcatcaggctgctgatgtcaaacacgacgttggactgcacaatctccacttgggtggggtggtacaggtgctgcgtgctgagcttatccaaggctgtggtggtcccgccaaagttccagagatgggggtgttgggaataagataaagagagagaacaggagttagaaatattgctggaagttaccagggctccatttctacacatgaatgttcgccataggtgtttaagcaagatcttgcaaagaaaatagttctctgacacctcctttctgttttaccccttttctttcctatttttttaattggatgtgtttataaattgcaggcaacaacaaatagaaaacacattcaactttcagataaagagtcactgagggggttttcaaatgaccgtggctggtgctaaaaacctcattgatttgttaactgaactgtgtttcaacccgagtgacgatggtgtcccctaccccccaccaaaaacaaaacaaaacaattcctaactcatgccatatgggcaggctcagtgaatatcacttttctgaataagattcaccccttataatacctgaatggttaaagaggaggaagagagtgttctttagacgacaggggtgaaagacctaatttggagggaataaggaaagctgacatctgtgtggagggctagtaatttaagtcaagtcatattagctatagggggttatccaaaaacttagttctctcaatttctctcgttagtcacctgttagatagcttttgtgttcattggcatgttttctgaaagttattcaggataaaaaagaaaattaaagtcataattttaaaaagaaagaaataacaagtcactttgttaatagctctaagggtacagatgaaaatggaaacaaatgacaaaccaacatttgagaatttctggtgtatttcagctaactgtattatctcagtagaaaaagctgaggatgaccattctcagagtaaacacttttaataaaatgaaaagttcaacaattgggtgctttttctcctcaaatttaagaaacgccatctcttctctagaactaaaggccaaaataaggtcataaattccagtccccatccatatctgagttactgcacaccctattgctgataatataattacattttgcctcagtttctcaagcaataacactgtcttatctgtagggcttaaagagatgctgcaaagattagtgagataacgagtgagaggcactctaaactccttaagagaacacaaaaggcattcaaaactgtcagaattatatgcatatgcccatttaggaattaaacaagatgaacacataagcctgaaggatggtcatctaacctcatgagtcaggcaaatgggtatcagccaacatctaggctcaagtcataactacacctaagttatgaacctaaggtttctgcaaattctaaactacagtgtggcctttctcagcggcttttcctaacaccttatccctaatggtacgggctacactacacgtgcattctcagcaactcctattttactacaccaatattactgcataatcatggaggaatttaaaagtgcgtgcacacagattttttagtatttcatatgtattttttcagggctcctcctccactctcatttcctcctgacttgtggtcactagagagttcatgtactcttgataaattgctttcttacatccacagtgtaaaggcccttatcatttacccgctggcttcattcaacacatttactcccaggaatactttgtcaaagagttcgggttttctcatacttcatttcttgcagctgatttgtctgatcttccctattctagtggttaagtcaactttgaataaatagccttaaaaattaatttaacgtttgggaaagataagggcttcacaagcctagggattgaagttttctctcactccacagggcatttagactgcaaaaaagcagggatggggtattactatccctgttcttcttcaagtacagcttaactactcagccttctgatgagtggctgctctgctaacagaatccagtgaccagatcgggggcgatctgctcctcctccatttcccttcatcagctctcctcaaccgtttcagatagttctttacaaaacagacttctatgacaacagcaaatatgaaactgacaggagtcagtagaaaggaaataaaatgacacaaaatcctgatttttgtgtgtgtacttggcaccttgcatgtctgcattaaatacatgcaggtgtgtgtgcaaatgcgttcaaattgtaggtgaaaaaaaccacaatcactctccctcccactcattaaaaaaggttggttgttttattttgtattattttttaagacggagtctcgctctgtcgcccaggctggagggcagtggcgcgatctcggctcactgcaagctccgcctcccagtttcacgccattctcctgcctcagcctccagactagctgggactcaggcgcccaccaccacgcctgactaatttttttttttgtatttttggtagagacggggtttcaccatgttagccaggatggtctcgatctcctgacctcgtgatccacccgcctcggcctcccaaagtgccgggattacaggcatgagccaccacacccggccaaggttggttgttttaaagatgaagagcactaaactgttaagggtacagaagaaaagagaattaaaagagcacagaaagaacaaaaatatttccctagatatgctttcgagaacacctgagactgaggatattataaggacactagttgattcttcttcataagtgtaccatatgttagtaagtatgaatacagctgggcaaggtggctcacacctgtaatcccagcactttgggaggcgagacggcagattgcctaagccaagagttcaagaccggcctgggcaatgcggtgaaactcccacctctacaaaaaatggaaaaattagctggacatggtggcgcccacctgtggtcccagctactcgggatgctggagtaggaggattatctgagcccaggggagatccaggctgcagtgagccatgattgtatcactgtactccagcctgggcaacagagtgagaccctgtctcaaaaaaaaagaaaaaagtagaaaaactgttataaaccacataaatatagagcaaaggtcaacaacttattctataaaggccagatattaaatattttaggtttgtgggttatgcattctctttcacacctattcacctctgttgttatagcaagaaagcagccatacacagataagacttaaactattaggtgtgtcaatgttccaataaaactgtacttaggccaggtgcagtggctcacacctgtaatcccagcgctgtgggaggccaaggcaggagaattgcttgagcccaagagtttgagatcagcttaggcaacacattgaaaccctgtctctacaaaaaaataaaatattaggcaggcatacctgtagtcccagctacttgggaggctgatgggggaggactgcttgggccctgggggtcaaggctgcagtggagcaatgattgtgccactgcacttcagcctgggtagaagagtaagaccctgtctccaaaaacaaacaaacaaactttatttacacaaacagacacctcaccagctttgtttgggccctgaggacgatgaaaaggcggactagatatttaatggaagtcaatagtagatcacaaaaaagctctaagagtgtggtttaggaagcagttacctaggagatgagccatagatgaagacttaaaaaatattaaactgggccaggcacagtggctcacacctgtaatcccagcactttgggaggctgaggcgggtggatcatgaggtcaagagatcaagaccattctggccaatatggtgaaaccctgtttctactaaaaatacaaaaattagctgggcatgatggtgcgcgcctgtagtcccagttactcaggaggctgaggcaggagaatcgctggaacctgggaggtggaggttacaatgagccaagatcatgccactgcactccagcctggcgacagagcgagactctaactcaaaaaaaaaaaaaaattaaactgcctaacttgcaaatttcagcataaacatatcatcaaagattatgatctgtcaaatttcttgaatatatcaaaattttctgctttataattactagatcatatcgagtcaccaagttgtgacaacttttggggaagtatccatggaactatgatacatgatgattttttaagtgtcataaaatctgtaagctgagaactagactgctgcctaatttcatgatcttcacatatctgactgtggaggagtcaggtctggatcttgtagggttaggaatatgagttaggccaatggcgctgtggaaaaggtaggtcaagaactcatttatcaggatggagtgggaaaagatgtcacctactttaatatattatgggcctaaccatctgctgatgtgtcccataccaatggtattgttaagattcattttcaggccaggcaccgtggctcacacctgtaatcccagcactttgggaggttgcagtgggcgaataacccgaggtcaggagtttgagaccaggctggccaacatggggaaactccacctttactaaaaacacaaaaataagccgggcatggtggcacacgcctgtagtcccagctacttggaaggctgaggcaagagaatcacctgaacccaggaggcgaaggttgcagtgagctgagatcgtaccactgcactctagcctgggcgacagagtgagactctgtcacaggatttaaaaaaaaaaaaaaattcatttccaaatgcaatctaaccagaagttgcatatacaaaatatataaaagtgaagctgttctaggtgaagctggagtaatcatgggtcagagaacatccaatcaggtattactccctttttctcttcaacttgcttaagtatctcagtgggctgaactgtacttgcttaagtacagtttgaaaagcccttttctctatagtgagttgataccaattttttgcctgacttgtgtccactccccttcactctggtaatagaagctacatttccttttgggaacttgtcccttacactcaacaccagtatttctttcttttctgttttttttttgttgttgtttgtttgtttttttttgagacaggttctaactctatgacccacgttggagtgcagtggcaggatcgcggctccccacagcctccatctcctgggactcagtctcccaagcagctaggactagaggtgcatgccaccatacccagctaatttttctgtattttttttgtagagatggggtttccccatgttgttcagcctggtctcgaacttctgggctcaagtgatccacctgcctcggcctcccaaagtgttgggattacaggcatgagccaccatactcagacaataccagtatttcatagaactgaatactccttagccaggcctagaaaaccagtctgctcccagcaccctgagcataacaactggttcaagaataggcaagtgacctaagtctggacagtgcaattgaatccaggaacttacttagaactactgggaatttcttctctttcctctaaatttgtacctaatgaatatgcttgagaatgcaaatcatatgaagaagatctaggctgcaagacaatctgacaaatatctagtactgataatattgtttgattgagaagatttggcagtgctttgaggctggtactatccctggaatcttctgttacatgagccaacaaaatctgtatttccttgtccctccactacctctccctgtcccctctgccattttctcactgtctacttgaagtcacattctgtaagttggaactaaaagagttctattacaactaccctttgaggtacttttctagctgattaaaaagtaatttcaacgtcaggtgcggtggctcatgcctgtcatcccagcactttgggaggttgaggcgggcggatcatgaggttaggagttcgagaccaacctggccaacatggtgaaaccacgtctctactaaaaatacaaaaattgtccaggcacggtggcgcgcacctgtagtcccagctactctactcaggaggctgaagcaggagaatcacttgaacccgggaagcagaggttgcagtgagctgagattgtgccactgcactccagcctgggtgacagagcaagactccgtctcaaaaaaaaaaaaaaaaaagtaatttcaaagtagtggtcggtgttcaactaaaagtatgttagttccaggctgaatgcaattcacaatttctgcaatgaatggaatgaagagtattctaaacaatttcacatcttatacggatttacaaagagggacgaatgccttcaacagcattaataaggaaaaataatggtgaggaagagtataaagaaaataaccctttaagtatcaactatatatcaggcatcattctagagcaaatttgtccaaaccatggcccaggatggctttgaatgcggcccaatacaaattcataaactttcttaaatgagatttttttttgccatttatttttagtttatcagctatcgttagtgtgttagtgtattttatgtgtggcccaagccaattcttcttccattgtggcccagggaagccaaaagattggacatccctgttctaggggctattagctcatttaatccttcaattaaaaagcatacaaacacagtattattattattgcttattctgagattataggctcaatcaggttaggtaactggcctaaggtcacttagcaacttcattcaagaaaattctgttttcaccacatgttcgaataaatagtcaatatgaaacctgcaagtcctcatcatgtcggaagtccctaactgccagcaatctgggctacttgcccatcactctgctgaagcaagcatttcaaaggtcaccaacacctgcctttctgtgaaatccaatagcttttttccttcattattctccacagtctctccatagcagctgaccttattgatcaccactcctcctaaaatgctctcctccttcattcatgcatacattcatttatccaccagcacctattaacttatctctgaggtacgtgctgtatgcagatgcaaaagtaatttatgttgtggcctccaccttcaaaagcagacagatgtaggcaatataaatgccataaaaaagatttgacaaagtactgtgggacacagaagagagggcaatgctgccgggaatgcagtctcctaactcggaagtcagcaggcaagaaaggaggaggagactactgtaggtagacggaactaaggcagtgattctcactcattgtgtgcatcagaatcaagtggaggacctgttgaaacagactgctgggccacctcccccagagtttctgattcactgggtctgggcatcaagaatctgcatttctaacaagtctccagaagatgctgatgctactggccaggaccatactctgagaatcactgaattaatgggtatgtgttagggaaccatctaaagaatgtaacacttgcagcaaaatagttggaaattagtccaaaaagatcagattagcagactgtaagtaaggagctgtatttataaaggcaaagacctgtggaaagcttataattttatttcttgttaataggattaggaaagtattaaacattttataagaggaaaatgggtaggtgtggtggtacatgcctgaaatctcaatgctttgggaggctaagatgggaggatcacttgaagataggaattggagatctgcctggacaacacagtgaaaccatgtccacaaaaaaaaaataaaaaattaacgagccaggcaaggacaagtgtggtagagcaagcctatagtcccagttacttgaagcaacagagacaggaggatcacttgagcccaggagttccaggctgcagtgagctatgatcctgcactatactccagcgtggatgacagaatgagaccgcatctctaaacagcaaaagattaaaagataaaaatgatttttagttttagatgtaaaattctgataagagtgcagaaatttaattaaagcaatagttgtcacatgggagacatgacacctatccagcaggaacaaaagctggtgaaggtactggatgaaccttggccacagagccagaaccaaccaacgcaggaaagttcagaagtaagagggttgttttaactttgaaaattgtggccaggcatggtggctcatgcctgtaatcccagcactttgggaggcccagcactttgggatcaccagaggtcaggagtttgtgaccagcctggcgaatatagtgaaaccacatctctattaaaactacaaaaattagccaggcatggtggtgggcacctgtaatcccagctactcaggaggctgagataggagaatctcttgaacccgggaggcagaggtggcagtgagccaagactgccctattgcactccgcctgggcaacaagagtgaaactccgcctcaaaaaaaaaaaaacaaaacccacagcctttgaaaattgccccagatgatcatgacacatatgcccccactcacataccacactgaaaattggagatagaaacggggagggatggcttagagccaagtgaagagagcagggcatttttgcattactccactgggacatgacttaattcagtggacttctcagtagagtatgcctaagctcagggtataaaaaggccttccatgaggtatgcaaacacaaggacccaatttccagatcttgcagttccatatttactctaaaactgatccacttgagaatgggcctccaagtacatgaattcattcttgtttctcttctgaaaattgtacccttccttctttacaaaataaaggtagatacttggcttatattctatatggtacactagcccagggtgtaaaactcttctgagtgctaaaataattcacaatttgattattaaaagaattaataggccagctgtggtggctcacacctgtaaatccagcacttttgagaagctgagccaggtggattgtttgagcctaggagttcgacaccagcctgggcaacgtggtgaaaccccatctctacaaaaaatacaaaaattagctgagcatggtggcacgtgcctgtagtcccagctactcgggaggctgaggtgggaggatcacttgagcccacggaggtcgaagctgcagtgagccgtgactgagccactacactccagcctgagcaacagagtgagaccctgtctcaaaaaataaacaaacaaaaaaaacaattaataaaggctcatatttccctgactatacacagatgagtaaagtgtagctagatctcatacaggatttaggactatgctggaatgttcagaattcagacatcatgtaaaatgggcaatgataatgaactctcctcttacattcttatctattttagtaatgtattgctctttagaaagcatcctatgggagcaaagcatgagtgtccaataatgaaaatggtctccctcctcgaaccccacatattcaaagctaagatattcttttcaactatcctcaacactcattcatccctaggaggcgtcttcacctgggaagaaaagcccctaagcaaatgtaagtgatgcccactcttttaattttagtttgaatattttcctgtccctacaaaatttgtagaacacactgaataaaaggtgtggatagaaatgttacctaatttctttcagaaactatgtttatcatttagtaaggtagttacagcctacataatcaaataatagcaaaatatttaccattaatcatcattttcatcttaaaagattttgaataccttctacatactgctaataaaattaacagaataaattataatccaaatgtcaaagcacttaatttttagcaagtatgtaagttcctctttcattaagcatataaaaacagtttggtcatgatacctagcaaaattgataaatatttttatatattactcttacctaattttttcctaaagtccaacactaaattgtgtgatacacatggaaccgtatttatcaaagtgatatcatgacttctaacatacttctcatttcataaataagttatatattatagtacataattactaattaagtaaagagaaatagcatgtgtattataagctgaataaataaattttactagcaccacattttattctggactgttttagtaatgtatcataaaagatgcattccataacttattgatatgtttttataagttttcacaaagtgcatttatttgaagtgaaatgtgaactcagctttttctaataaaaattaagtcaaatttgtcagtcccactgatcaaatatgatcatttgaccatatcattggatttgcaaattaggctacctggtggaaattttcatcaattaagatagctaagtctgcaacagtaagataaaagcattttgttaaaaaaaaattgcagaagttatttgaattaaaaactaatacagtatttttattttctcaatcttttctgggtatacagggataaacaacatgcctctaaactgaagactaacgattaaatttatagggcaggacttggtcgctcatgcctataatcctagcactttgggaggcctaggaggacagatcacttgaggccaagagttcgagaccagcctggccaacagagcgaaaccctgtatctaccaaaaaaaaaaattataaatcattatttgatataatttcttaaagcccttttccataaattgaaaaagaaatgactataacaatatctgagtaatacgtaggatggtttcaatttcttagcttttagcaaaccaatcaagtgctgtgtaatttttggcatataacttgaaatgacttctaagaaatgaatgacaatgtggtaacaaacctcctagtcccatgtattcatgtgaacagatgtctcagcagttacagctgtagaaatgaaaattgggactagaactgatagtgtaccttttctcttttttgtaataagtactattcatccatggatacatgaactaatctgagaagaaaaaaatttatagtcccaactatttcaccggcagatacttcactgacagatacatttctaacaaaaacccactttatgtttaacaaattgttaaaattagtaatatttatatcgcttggattttatcactgtgatgacagtttttaaaataaaatttctatttctaaatattttattaattttcattgtaggcatgcatgttgagtgataaaagactttccagtgaacatttatggtaatgttatttgggggaaaaggagtggaaacaacagttaaggttaaaaaataatgacagaaagcaacaatttcatgtttccagtgtttttaaaagatgctcgttgtcttccagattaaagacagagtctctagggccagagtctaatcccagctctgccacttacttgctgtaagatattcgtaagtaactcagcatatgagaatgttagggtagtccttagttttcaaaattattttaagtataagcaagccagtgacctgaagactacaatcttaatgtaaggagaaaggagaagaaagcataaaatcaagaccaagctaagaagtaggaggaaaaacagatgcttgtagtaaagatgaggcacagctacaaaatgattgggattttccagtttggaagatctggaggcaaaatcaacgagattcagaggaaacatcaggtttccagacaaactgcctctccacctgcccacctgtgatcatttgcccctaggaatccaactattcctacactatgcagatgatccctaacctttaaatttcgctctgcccaagctcaactccaaacacatacttgactccttttgctgtgaaaggtagaactgggaaactaggccaaaatatttgaaatcagacttctttgtgtgtcattttctcataggtgcttattgacaaaatgttctaaattcaagaaaaaggaaaacaaaaagacaattacccataatcccaccacccaaaacaatgattgtccacatgttaagatgtatctacatctacttttttcaatacataactttatatagttgaggtcatactgtagataaaagtttctatcttggtggcggtgttgtctcccttaacattatctagcacgaacattcaaaattatctctgactactttcccttgcttccgtaggtcatcgtcatccttaatcactttaaactcttccattgcagtttttcctggatcaatttcttctttctagtctaatttataccattttagagcaggcttttagaccttcataacttcattactacaagggctcctaactgatttggtctctctctgttctcactggcctattatatgctaaagaaaaccaagtcaatcttctcaaaatactgcttagtctttcctctgttcaaaatttccaatgacgtccccagcctcttcacacacataactgccccacttctctctcacccacacacaaaatccttaacctgggtcagaagaccttggacagattgatttactttccagtctagtaactctctgacatgggccctctgatctgcccaaagtaaggttcccagcaccttcacatattactagcactttactatttggtcactaaatgtgtatttcctgtcccatgctaagttttagagatttagtgaagaacaaaacagctatgatttgggcccacttgaagttaatacactagtgaagaaaacagacttttaaaaattacactgcagggcacagtggctcatgcctgtaatccagcactctgggaggctgaggtgggtgggtcacttgagctcgagtttgagatcagcctaagcaacacggtgagaccctgtctctacaaaaaatacaaaaattagccaggcattgtggtgcacacctataatctcagatccttgggaggctgagatgggaggatcacttgagcctgggaggtcgaggctgcagtgagccaagattgcgccactgcactccagcctaagcaaaagaatgagccccatctcaaaaaaaaaaaaagcaacaaacaaataaacaaacacattaacacacaaaattacaaactggatatgtgacatgagaacataatttcaatggggtgggagtcgggtattccaggcaaagccaattcggccaggacatgaacaagagaagaaccaagatgacgccagagagataagcgaggttccatccgtaaagctgtattttctcagaacgtttactttcaacgctgttcaagtgtctttcttctttcttattaactcctctaactaccttttctttcccgtttcgatttatattctattttctttttccatgtagcctagagaggctccctcatataagaggaaatggactctaccatttcctgggatcacttatgttcctacttatctcaagaccttgattttgagcagcaaccatacctgaaacaaaatcactaaagagtgttgagtaatcatactgttggatggatgaacacagttaagtgtatataatagaataaaaagccattattctattttcaatggaaggggtaaatgtatgattccaccatgccaccaaattcttaatttcatccatgtccctttctcaacccttcttttgttctagacagcaccccctcacagaataagtgaaggtgggtaattaaggcaatttggagggtaaggtggcgctgctagctaagcaggaatcctgagtaaacttggcatattttctttcttactaggtcaagtattacttgggagattacaatgcacttttagtagaaaaacaggatagaagtctaatatggttaagaaaaagaatcttaattgcaaggtacacagactgaatcataatacacagactttatgaaaatcatccataatggtagcacaaatcactagatttgtgatcaatacgctagactgatggccttatagctatagaaaaaggtgtagtatagaccctggaaagtcgtcagagaatagtcacacagtaagactgtaagaagagcatctataaagacaggattatttttcttttgtaaaagacctggaggaaaaacaaacaaagggtcaattaatctctttttagtatgcagaatttcatctggaaaaagcaaaagctttaactgcaagataaagatattagaaaaaaggaaaaaaattcatacaatacaagctccttaaactgtgaatgaggttactgatgggacataatttacttggatttcctaaaatgctagaaacagaggcctaaactggcaattttatggctacaaaacaaaggagaaattgaggcctggatataatttcaataaatattttgataagatctatagttttccaaaggaacatggtggctaagccacaggaccccaaaatgacacttgagtctgaatgaagaaaactcatttatgtgggaacagaattgccataaggacaacagctgagatttctgtgcttcattaatgtatgtaatataaatgtaaaatgagcataaaacataatgcaaaatgggtaataaatgtaaagtaatatgtacttttaactatactgctaacttaaagaacaaagtaatgtcctttataaaattcagttttcaaatgtataaaatagtgctgggggtgggtgaggggtagttataaaagaacacatctatcacatgaaatgcgaataacaattttttatttctattttaaataacaggaattgctcctcaaaccttcaaataaattaaaataaatgtaaacctgtaattctacagacttcacttccaatattttctgtgaaggtcacagaaataagaacatattcagatacttttttttcttaatgtaagagtataaaagtgcttttcactgatcctacaaaattggctctcagtgatagtttatagttcttagttttccacaactttttttaaacacaactttccttaaaagtcaaattcaagtgactcagttggtttccacaggaatatgctcatttcaggtcctgaggtccagtggagtccatctagctgttcaggcatggcagtgtgaagctagcagccattcaataagataagaagtatgtgaagtacaatgatttttcaaaaccacttactttgtagaataaaacaattaaaaatctgtacgaaaagggtctaaatggaaacctgttatttcactaattttcagtcctgccctggatatttcaaaatttttaatgctaatttgaagtaattttacaagttaaaaaagaaggcttattcttttattttgggagaaagccaagtgagccttaaattacaaggctaattgtttcgagaactctgggtctcttgcctcaactccctttagaattccaaattacaagcatcaagtggtcagcttttaggagctctggatcctagactactatttgaatttccaatagattaacatttaacacacgtctttagggattgtttttatgaaactctttccacgattactttaagagttctaaaagttgttagcgatgagatttttattggagcaatttctggggtcagattttaaagttttcattatttataaacagaatatttttaccactcctatctcaaatgtccaggccataacctctgaatttatgagggtggtggctcttcatttttgctaatacgaccaataattttcaattataccacacttcataataagcacactatacccaatataatgatatgtcatttcaatgtacctagcccatgcacttccacaggtttaatgggattttgcgtatttagaatttcatcataaaggggccctttggaatcattatcacatcaatcctttcccattgtaagactcagctctcttaccaggcaaaagcatcagggctcaaggcaaagacttagtctactcttagattgtaagctagatcctaataaaagccttaacacttggggagaacattaatatagggcaatgatgacacattaaaactttttagtgaatcaggagatcgtgaaggcaggcaacaattgtgattaagagaaaaatttcttatgacgtgaagtaatatttagatctgcacattttattcactacttctgggggaaagaactatgtaactgggagcaagttaagtacaaaataactcatgttccatttaagtcacaactttctaactgtaactgtcaaggttgaattaattaggatatttaataccaaggcttgcttctagagttttttttttttttttaaagagaagaagaaaacgaatggtatttagctaaaagagttgatccccaagtgtggtgataaaaactgtcaacccttatgtacaaagggtttttttttttttcttcaacaaatagtgtgtcagtgttttttaaaatgaataaactccactgaacctctacaaatcctcattacattactataccttatatacattatgtgaatggcccttgattttttttctcatctcttaatacatgagggataatgtataaatactctcatggtttattatgaatgtaattccaaactgtagggagggaagagggacaaaagtagttccagttaagccccactgtcctacggattttaatcaacctcagttgacatgtagctttcagggtatgtggatatacatacacatataaacacccacaattagtccagggtagacactgagctccactcgagactatacagccaatatttcaaactgaatggcatttccccctgtggccttacgcataataaagtcctcaaaacagactttgaaaagcattaaagtctgactgaggcacacataaaagtatttcaccactcggttgttcagaagctctctctcctggctagtagattaaacaggtccttggttatacttattctcccgcttcttctttcttacatggcccacttttgggggcatgcctttgctcttttgcagcaactccacatgaaggtggtaacaggcaaagagaaaattttatctgcaaatttgacagtagatctaagaagagatttagtaactgaatctacttgctgaaaccaggtttgggaattattattattgccactgctgttctatccaatctccagttgcctcagccagcttaaagttggctacacaaaccctgctttatccagtttatgtaccaatggatttaatacacagtacactgactataaaacatatctcattttaaaagtaactattgagatttgctacctgaattaactatgtacatccttttattaaacaaaaatacgaattcttctgtaagaaaataatcaccctaccccccagttattcactttaaagacttaattttcttaaaggaacatatatctatataagaatttcattaagcaaaaagtgcaaaggcaaggcatatttactatttgataaaatatatgctttaaactatcacatgtgaaaaaatatttcaaaattgagagtcgtggtataaaaagccagcatctggtagggaaatatctaaaagaaagaaattattatactcagtcttgaaaaagaaaaatgaatgtcacctttgtgtcacaagtaatttttcctccttcccccagtaattcaggctgaaatctcactctaaatctataatcaatctgttttccccactgtaatcccttaaaatctctaggctatcacacacacttttggcactgacgtgtgttttcttctggactgctggatttgcttaatgcatatatcaagtatcaaactgctttgtatcagtaaccggtgggataaaaagaccctatgtaaagatttcctcataaaaacgggttaagagggcagtcctagggcttaggaaaagtctaacctaacgaaatcttaaatgcacaagtagaaaatgttaagaactaaagcagtatctgccgatttttccactaatgtgatcaacatatcattgagcagatagggaaacctaaagttaccatcccattctctattagtgggctgtttgacatgtatgagttatcaacaaggcaaaaactcttttgggatttagaccattggcaaaacgaaagtattttataccatcacacatatttaatggagcgcaaactttcagaaaagaagtgacatctgaaataatgtgaataaagaaacagaggggatatattggttagtgctttgaattctgtttactaatttgatcatgatagtaaccctaatttctaattagaaaatttctaattagataagttcaattaatcagtaccaacgggcacaatcaaaagagtcaatacaaattgtaaaatgtagcaatttttccttgagatattttactgtatttaaaaaccagtaaaagaaaacacttgccaaattcatttagtctctgactgaggcacacatatgtgatctcctaatttacagcttgcacatacagatgttcacacttagtaaaagggcttcttaatagctttttttaattaaaagtgtgttgataataggtgttttaaatatatccaaacaacacagctgaactgacaaatgcctgtcttcatgcctcaccatgtctcacattgtagcaagattttgtaagagagaaaaggttatatgattcattcacatatatataggataaatgttatcccccaagaactccaaatgaaatctttcattaatttttccttctatgatctgtttccaagtagaaaatgttagatagctactcggtttatgtagccgaaagcagaaccacacagccgttgcttgctgcctgcagtttttttcctttgcaaaactttgaaccccatccagctttgacacactgcctcttcagttaataactatcaagtttccccttgtctcctgtctacttttctttgaggcaattgcgcactcagcaccccgagataataacacacatctataagataaaagcaatggcattaatgtaattgtctgcctctctctctttagcctaatcttttttttccttcagttttgactgcctgtgtgacacctgtttttgtctcctctgatcctacgacaggttttccgctgacaaggtttttgcctgacacagattctgcagacaagaacataataaaatatgaagaactgcttgtcagagtttctgccaatgctcacatgaaatatagaaaaaaaaatgactttttttttaaggggccttgtgatggtcgcttttggcatgtcagaaaaaacacctccctagccaagttctccaagccaaacaggtgttttcttttatgttagaggttgatttgttttttaatttttactgatagtggaaaacacgattagccaaaaggaggcgggtgggtaatgtcttaccctcagatttttgcaggcaaaggaatataaaaaaactggaaagccgaaggtatttcactcaagatcttatcttctgaataaaacaaaaacaccaacatctgttaatgattaaacaaatttaacttctctaaaatttacttcctggatgtttgggctgctaaaacctcccacttacctttcacttattttgttgtctgaagacagagggaaacagcaaaggtgaaaatagaatgagaactggaaaagaaaaacgcacaaatgggcataaagacaaggtgtttgtgggctgtgcttataccttaaaatgggaagaggctgctggaaaagcaaatggcaattaggaatctgagtgagacttttccataagcttagagtttcaataaacctttgttccatgcaccacatgagatgctgcagtatgttccagcacacaaaggtgaagtgcccttcctgagcttttcaagttagtggaaggatcagtattacccagaaacctctggtctcagcaaagtgtattgagaaaataaagaagggagcacttaattgctccgggggtggggagtggtggtgcagaggggagtaaaggggtgggaatcccactttcttgatgaacaaggcacaggaaaaactggccaggatcaatagtgcagcaagcgtcaaagtacgaaaaactgggaaagagtttacagtggtgactcaagggacaagagcctggatttagggtgttaggattatcacaccaattctaactactctgccaccaaaccactttaacctaggctttagctctccaaatatattctctcatacctagagcctacgattaccacgtctaatggaaatataatttatggccgggcacggaggctcacagctgtaatctcagtgctttgggagccagtgcgggaagatcatttgcatctaggagcttgagaccagcctgggcaacaagacgaaaccctatctctacaaaaaatacaaaaattagctgggcgtggtagcgcacacctgtggtcccagctactcaggaggctgaggtgggaggattgcttgaacccaggaaggggaagttgcaatgagatgacattgcaccattgcatctgggtgacagagcaagaccctgtctcaaaaaaaaaaaaaaaacagaaaaagaaaaagaaagaaatataattcaagccaagatacagaattttaatttttctagtttcaagtaaaatagtaaaaaagtgatgtttaaaaacgtatttgacatgataaatcaaaaatatatggaagaacaactcttaatgactattttacattctttttttaaataagatgacagctccaaaatttggtgtacactttatacctacatcacatctcaatttggactagccacatttcaagtgttcaaagccataacagtggcttccttattggacagccaggtgtagagttgcctttacatttcttggcgagtagaatctaaggcccaagactgtcctttcaattagatgggtttgcatttaaatttgtagcgtcacttgactgtacagaaggcaaagaggcccatgaggtcaaagtggggatctccctgggtaccagggagcagctgaacgaagagaggaatctcactactgggccttttaacaaatactggttacaagtctatccagttgtggtaatacttaaagtaatacttaaagcacttcttatacaattctttgggtatatgcgaactaataacaaattaattcaagaaccttttgaagatatataaacatctacaaaggcaaaacctggtaagaaatgggatgtataaacaacattttagggctcccagaatacaattcagagttatctttgaaatactgtacttatccagcaatttcacacttcagtaaagaggggagaggagttagaagtcaccatttatgacataatagagaaggaagagtggttgaaaggatcaacatgatattgctgaggcatatggggtccttacgacccagccgaatctcctagtttatcctgagtaaaaggagaggagttgagtgtgtttcatttataaacccttcaatttgtgttctgcttaacctggtgaactccagttaattaagatgctcctataaacaattaagcttcctgtaggatcgttagcaagatataaaaatttatgatgtaataaaatgcaataaaatgataaagtggcgagcccatcgaagcacttcacatgcaaaaagacaggtgtgaaaataggtaaaagtagccttaatcctacctaaaattcacctacttatagcttttggatttttagcaggtaaatattactataatttattttaactggcgcaattctcaaaatgacttttggtgtaaaatattccttactgtgttcaaataagggctcaaatgacattttaggggaaatggaaggtatggaactatactggatttgcttgggaaaacaatttcacctacggaacacttggtccaacagccaaaagaactggtgacctgacctctgcaactgcatactgaagaaaaccttccctggaaggagaaatagtttcatcccaacacattccacattcgtaccttaagggagacactagatattatcattaatattgatgtttaatattattttattgacttagcaataacaatactagctcctaaaattgttgtgccagaatattgggctaaccctactctttcatgtaatcctctctcaaaatgaatctgtgttatttagatgcattgctattattatccgaatttctcgatgaaataactgagtcttagagaaggcattactaacaaaaggcagagaagggatttgaccactggcctggccacacccaacttttaatcactctactttgctaaaacatgtctatcatgtccacagtgttgaagtcttacttttataggaagttagtgataacagcaactaacacttattaagtgtatactatgtatgaggcatctggattatctcatttaatcttagaagaacactatgagctaggagctatcatcactcacatttcacagatgacagaacagagagattatacaacttggcaagattctacctacagtaggtgacagagccgcgacgtgaatgtaaacagtctcattcaagaacaacattcttacctattttgtatattgcctcccattcattcacccgaagcgggatacagctctgtgtgtttcattctcaacaccctcccacgaaactccttaccagcagaccagcagtgactacactggaggccaggtcttgccagcctcactttatgttccatctgaataaaacatagctaggaaaaaaagaaaatctggggagctaataggcagacagcccaggactttgaaggggaggcactgtttgcgctgggtttaaagaaaatttaaggagtgcaaagcaccatccaaaaagtgtgcaggctgagaaacaaatcaaaagctgctcagagacacaataagaaaatacttagtgccattaatcaagcaccaaacctttgcatttatgaggatgtcttccctttagagcttatcagcagtgatcagcaagtaaaggagagaggcagaagagggcactgtgccctcaggtcaagcccaaaaaagcctcctgtgccaggcaggaaaatggccttgcttttgctctctaaaacgaagaaaaaagtccaaggactttgctcatggagagaccagaatccagctgcctcaccaaaactaggaggcagctaaaagctgttttccctgagcaaaagagaattttgcagctaggcaaagccgggtttcagcatttacaatctggaaaaactaagtccactagaaagacaaattctttaagcagatactgcaccagcttccgctttttccaaacgagtgcaccaagggaagaagacgatagtgtttctatccttgtgtttctgaacaaagccctagaaacatttcccctaaggatctggttcttactttgccactgctaagcatgtacttcccttcccctgaggactcaaattagtgcctgtgctactgttcaccaaaccctaaacacccctctggaaaaaaatttctacgaaagaaaatgttgttttcgttgggatagtctccaagccagagcttgctgggaacattatctccctttgtcagacgaaacttagttgttttttagtctcctctctttatcttgacacatttacaaattatcatatggacactgttgtggagtcactcagaatgagcatgatatcacagaaatgtcatgctttattcttatgataaaggaatttctatgcggagtgggaaggagagaagactagggaagaaaagagattggcaaggaaaagactggactactttagttatgctaggttttggactcaagtcagggagaatattagagagttaccagttgggaacaaaccactttcacagatatttagacaatttataagaacatagactgggacaaataataaagacatgtgaactttcataggacaaaatgaaaaattacttgttttgatctgccttgcttgtaagtccttacaaactaccatgcctccaacgaacttgaggaatttgtaaataaaatactgagatctcatgattctaaatgtaggactgatataatcaacagctttttttgttgttgttgttgagatggagtctcgctctgtcgccatgctggagtgcaatggcacaatctcggctcactgcaacctccacctcctgggtttaagcgattctcatgcttcagcctcccgagtagctgggattacaggtacgcaccaccacacccagctaatttttgtatttttagtagagacggggtttcaccatgttggccaggatggtctcaatctcctgacctcctgatccacctgcctcggcctcccaaagtgctgggattacaggcgtgagccaccgcgcctggcccaaaacctttttgattataggatgcttatgaccaatagccctgatttaggatttatgcaaattgagtctgaataggattttcttttaggtatgggcttgccagatttagcaaataaacataaaggactctcacctaaatttgcatggtaatatttatatttaaaatcatttattgtttattgatattcagattcaatcaaaaattctatattttctatttgggtgaaggtctctataaatacccctggtctgataagacatatcaagtacaagctgaaaattcaaattcaaccatgctgagaaaaaaaaaagaaaaattatatccagtgaatacaaaaaaaaaggtttgaaattaatgggttatatgcatattaagtcttacagtacattaaaccataaagctggttggtatatgatactaaattaactttatacttctcatcatttccgtggaagaactgaaggctacctggcacaatccttcatgtatgagataggtttaataaatatctactgactgatgatctggatgatgtagaccaggtctgcttactttacattaaaaaaaaatcaggagtttggagaaaatataggcaggaaaaaagctggcttaattagtaaataattaaagtaataatgtaaaactatcttttcctcgaatgaaatgcatgcagtaaaaggaaatcacatttacagaacataataaaagaaaggtctcaaaattccagtgcaacaagcattcttgcaggcagacctcagccaaaggaaataacactggtattaattcagatctcttgaaagtgaatgaagattctagtattcatgcagcttgttggaatggtatatcctttcatttaaagtcaaagaaaaaaaaagaaaataatttgcacagagaaagctgctgtgggtgcgttaagctataaaatgtattttttattcatcaagtctcatattcttgccaaatgctcacctcacatacctaggaaacagtggaattaaaaaaaaatttttttttgtttttttccaaaaaagagatggtcttaacaaatgagcttcatcagaagaaaaagttactgatctagtttaaaaaaaaattctaaatgaattacctctgtaaaatctgcccacctcttttatcaaatacacaaatcaaatatcatgggataaaaacaattttccagttgtactggattatcattaaatatttcctaaaacgccttagaattcagtttgttttctttcttatttttactattttatttaccttcatcttaatggtttagaaataaagtcctcatctaaactatggacattaaaactaacttgcaaatattaaacaataaaaatggtttcgtgcagcagtcctcaacctttacatcatgcctcctgttttttttcacgaagacagcaaactcctattggtaatgcttcctgttagaagcaggtattcttcaagggagaatagtaagtaggactcactcccacctgcacccaatgctgagtgtattctagttgtaccagctaatttttaacattctgtaaaatatttggctgaagtctgaattctgtgaatggccaaattgctactctagtgtggaggcaaagggtaaaaagaaaaaaaaaaattacatcaccagaaaaggagcccattactgctcttatcctgatatcttaatcttattttgccactttcgaaccaaaaagagctctaaaaaacttttgttgttattgtttttcaagccatactcagattgttttaggtgaatgaaggaaacgcactgagaagataaagcaaacaagggaaagtaaaaaatatagtatttatagtatttcagtgaagtagtggcagtaaactggagtccttttacagagacttgacagaattagaaattctgagccatttctggcccatcaactaaattattacagactaggtatggccatcttttaccaagagaaaaaaaaatgtttaagtaaattcaataagccctgctttctattatcagagtgaaagagctaagattccttaatgtgggcagggtggtggtaaggtaggaaatcctttattaatttagtgggaaatacctactggtattcagaactgctctgagattccttcctcccttaactcaatagtgctaaggattttaagaaaatactctgtgaaaagtaacacagcccactaagtattaataatttcaaaacccaggtgttgcagtataatgaattaatcactctttaatttattattttttttttatttttgagacagagtcttgctctgtcacccagattggaatgtggtggcatgatctcagctcactgcagccttgacctcttaggctcaatcaaacctcccaccccagccttcaaagtagttgggaccgagagcacacgcaaacacaccggactaatttttgtactttttgtagagacaagattttgccatgttgcccaggttggtcttgaactcctgggctcaagcgatccacctgtctcaacctcgcaaagtgctgggaatacaggctgtcagacacaccacacccagcttttaattttttagaaacacatttctaaagatttttgtaaagtagttaacgtcaacaacttacgcagctttagtaagcaatctgtaagtcaacagagagaatgtgcgtgtgtttctgtgtgtgtacatatacagagacacacatatgtgcatatatatggtagataatgacccatgaaatccaacatcttaggaatgaactgaaaatgctgttaacaaggataatttattcaagaaaggaggtcaacaaatttctaaaaatctgttttagagagaatacatgattttggcatttggttattttttagcagcagatattaaaaatttttttattgacataatgacaggtagaatgcattcagtgctaccatgaaaccattctgggcaatgtatcttggtagttttgttgctgttccatgcatttcagaggaaaattacacactagaaaacccaagtcacttcctcattgccccacacccaggacactgcacagtataaggcagccggaaagaatgctgtgtttcacctctgagcagaagtcattggagacacgatttcagggtttctgtgcagagagagggaatgaagcaattagttgtaatgctaggggcaaaaagagtgggtgctgtcatcccactgccaactccaaggctagaggccaacccctcactgctgtatttggcctcatgaatggggagagtgtgggattcacatgcttgggtgtatgcattttgagctgtatacagatatctccctgttgtgggaaaaaagaggtcaaggtgataattgtaaaggaaagaattagaatacattttgctaaggtctgagaaacaccaaaattaatatcctagaaacatagaatttttaatggtacagtagaaaaagcacagtctggtgtaacaaaaacatcttattcaagttgggtgaaaaatgacattcttcagaaagtcctcgaaacaatcactggccaggaataatttatgttgttcaagaaggaaaaaacattgctttttcctttacattactaatgtaatatgcacatggacattaaatagataaaacaaactggtgacacagttaacttttatactccaaggctaccatagtagatagataatgataatacaagatggctttggcaaaaatgagagcgaataaatgaaacgcctttgttcaacgactggcctcccctttagtgctcatctactgtccattttacttttaatatgtattagttagaaaggcttcatatattttctctttaattttcataataagactgtaaagtaggaactattaatcctattttacaggcaagaaaactgaagtccagcaatattaacatgtcatgaggtgacagagccaggatttgacctcagaacagtctacaaccaaactgcctccaatattcatatggttctgatgagtttaggatataagctctgtacctattacccagcaaaaccaatacttcttcagagaaaaaaaggatatttgggaactgttatgggcttgtgttctcccaaaattactatgttgaagtcataacccctactacctcagaatgtgactatatttgaatatagggtatttaaagaggtgattaagttaaaatgaggcccttagggtgggccctaatccaatctgactggtgtccttattagaggaaatctggatgcacaagaagacaccagtgctgggcacagtggctcacacctataatcccagcactctgggaggccgaggctggcagatcatgaggtcgggagttcgagaccagcctggccaacctggtgaaaacccgtctctactaaaaatacaaaaattagctgggtgtggtggcgcatgcctgtaatcccagctactcagaaggctgaggaaggagaaccgcttgaacccgggagttggaggttgcagacaccagggcatgctcccacagaggagagaccatgtaaaggtgaccatctacaaatgaggaggagaagcctcagaatgaaaccaaccctgccaacactttgatcttggaattctagcctccagagctttgaggatataaatttctgctctctaagccacccagcctgtggcattttgttatggcagccctagcaaactaatatatgaagagagacgaaatcattgaatgtagtaacataaagagactgcagaagtaaatgcagctcatctgttgttcaagactggactgagacctgttgctgatttgggccttgttaataaagcaggaaagcgctctatccctgtgggcatgaaggactgcaggattgtggctgcatggtggaaacataccccttcccgggtattcctctcagagtactctctctcacagaaacatggctgaaatgtccccgcaactccatcacacacgccctcacaagcaaggtacatgataaattaaaagcatttcgaggcatggcccagtgttgttacctcagatgttgctagaataacatgacatttataaaaatacaacccactggatgtttggcactgcttgggaatgaagaatatgtccacttaagaggcaatacccggggctgtcaaaaaatctcaagccaggatttctttttataaacattacctatctttttaaattctacagtctgggaggtggaaaaaaaaacgtctgcttatttccaagtctccttttacttaaacagaataaacataaaccatacacaggaatatgctgaacgctcggtcagggcacactgacagaacggctctgtgcacctggcaaaaaccctcaacactcatatccttcgcgtggggtctccccaccccagcacacacctacacagagctcacactctacctacgtcgaccacctccaatccccatgcacactgaaagggagtatttacaggttatattttcagataccagccaaataatgttcccgttcactctctcgtccacctgagaccatacaacatttaacatctagaaggataagctcagccccgagcacatacgacaagggtgagcagtcatcgaggagttctcaagcaaggaggatttgccagcttccctctgaggtccaggccctgaaaggccaactgtggtatgtttgagtttccatcaggcctggtgcttgctggctgcgcccatgctcagtaagaacttcacagcccaactgtcctataaacatcttggccttctgctgagagctgctcgcctagctccttggagctgagaatatgctgttttagagccgcaggctgaatcttaactaacacttggagcacagctgacctctctcttctccaggccagtgactcctctaaacagacacacacacacacacacacacacacacacacacacacacacgaacatgaacataataagaacgggaagaaaagcccagattttcctcaccatgtgccacccagccatgtttacactgatcacaagtcctcaggttaatcttccctggctgaaaacattcacatgtgcagtttaccagtgtgcaacggatggcctgaaaaataaaggaggaaaaaaaggtcagcatctgttcaaagatactatactcttttcaccatttcaataaatattgcccacttctatttttaaagattttatgatggtaggggcctggagagttttaaaaataaatttagatatcaccaaaatctcttattaaaaaaggtaaagaaaacaaaagctcattcactaatacaatgttttaggtcattcacagtaacctttaaattacaaacttagaataaaaataaaggattacatattcgataagataccggatttacgacatcacaaatccaaaaaagaaaaaagtatattgctgctaatatatatttccacttaaatttctctacttgtcaataaagcaaaaaatacactgtaacaaaataatattcaagtgaaatgtttgtgaaagtaaaatatggcacacaaatattattattagaatattacttttcttctgctgaatttcaattaaatgttgtgctaaactctcaaatatattttaaagacactcctgtgctcaataagacctaacatatttctattattatttaatcacatcccaattccttgaatattttttattctattttcgttcctgttttgaaaaataaaaaacaatcctcctcttatttcaacagtgacataagaaagaaaataagtttaaattttggtttcagatcagacatggaacagaaaaaatcatttatgtgaatattttatatctggaacagtacacctgtattgcagaaaactgaaaaacacacttaaaaatctttcatttccttataaccactttaaaaaaccatctcaccagttaatattataaaatgaatccatagaaaattagcataaatggagtgtaactttttatgaataaaaacctatgtttaagaatagtgctaaagctgacctaagctcccggactacagttaataaatttatctcatacagttaattctaatttgcatagaaattctgaagacagaagggatttagtctgatcattcgcagattaacaatctactgtaactacttgaactgccaggaaaagatctctctgcagatttagatgcaatcaatgattactgattctggggtggaggggtgggcatggggatacctgaaactgcagctctgtgcctgaaagccatgctcactcacacagctccagatgctcatatttctggaaccattaggatttttatagaaactgtctcatttgtaacaggcagtattttggatattgttaacatgactgggacaaattccattcacagagaataagactgagcaggcttttaccattccctatgctttagatcaggcaagtgtaaaatatttctcttccattaattaatattaaatctatggatccctattggtttcagatgttggagtcctcactgtagactccattcatacttcacccccatctttaatttgtgcttcaatttagcactagggaaatatttaattgtataatctccctgatatttcaggatctctcttccaaacatggtccaattgtagctaggttgtaaactttgttgtatatagaagtgattaatttgtagactataaggagaaacgtttcttccagaagttcttaaatttcaataatttgttaactgagaaatatatcagaacatcccaagtcagaaatagtttatttaaataacatgttcattagttaatgaactcaaaacttgattgtactgtgaccaaaataaaaagagcttagaggacagcatttccactaaaaacaagaactttacaaattatctaattataaattcagatacgggaactatgttgacattaaaacattcatataatttgaagtgcaataataaaagctttcataaatgctttaaaaaaaatagctctgctttaccgaaatcaagggagggccaataaaatgagatggtatttcaaggacagttaatataaactccagcacaaaagacacaaatatttaaatcattaatttgataatatttaattattttataaaaatatcctaattttgtattgtctttaaagcacactttcatcaactttaattacagccatatttaagacgagaacaaattaacagactgtggatttgatttatttttatgtgtatttattttttttactggttgaatcattcattcacttactctgaacaagtttatgattcaaatattttgtcttcctaaataactttacacatttggtacattcgggaattcaactttttagatcattattcctttttatgaattctattctttttgtacctaaacatgcaaacactggaacacctcaactccttttgtatataaacacttaagcactagaatatccattttgtatatctatgaattccagaaggtctatttgttttaaattcagatttatatagactacaattttcccttaagagaattatatatatttaaacaatatggtctaaataaatattttgagtaagagactattgccgcttcaaaggaagttttattctaaataacatttttgaaacagcataaaactttgacatactatttattcacaacaaaatagaaccaacgtgatcactggccaactcacccacacgcaaataacataagttatcataaaactatcaaaaccagttaagcctcaaaaatgtacatgcattacaaggagacagttgggaagagtcgaaatgaatatgctttcattcttgtgagcatgttcacagctgcctccattcagctcatgtctgagtgcctccaaccctcttctgggcactcgggacaagaccaagctgttatattctctgaactacacactttgaaaatgcaggtatgcagaaaggagcagagagttcagtcagagtgttcccacctatctatgcagagattagtattcaggtctgggtaaagcaggcctccaggacccagcctaacaagggtgccagggtgccttgtaattctttcctcaatttccattattggaaactgtctgctcttttctttatacctgcattttcaaagtttgtcgttcacagaatgtaccacatacagcttggtcttgttccgagtgcccagaagagggttggaggctctcagacatgagctgaatggaggcagcagtgaagatgatcagcatatcccaactccccaagaacaaccataacaacaaccatacattttcttaagtctgcaccttattgaaagtaattattccttctgcttacctttaccattgacttcttgaaagagaaatccatgcacccagcaaccagtgctcccacttcctcaccaccacctacattttaactctacaatccagattctgccccacacgtgcctgaaactgtctctctgagaggcaatgttctcatcccatctggtccttttttctagtctccttgtcctcccagactgtgatgcagcttgctgcactaactctccttcattcctgggctgtagagactgactatcctagtttttctggcatcaactgctctctcctctctctctctctctctccactgtaaataaatacaggtgtttcccatggccaagctcttcattctttaatttggcaacttcacgccctcctacagcttcaaatatcaccactaagcaaaaaccgtcactgtggagccaggcactgcctcttaagtggtgggaagtggatggcagtgtccctgtgatcaaggacttgatagtttggggtttgggggcagtgagtttagaggagagaccctaactaagaacataaatgaaacccttacacagattggaggactatctcctatgcattattcctcctctaccaaacctcaggattttaatttatttatttacaatagtaaattattacctgttataataatagctagatgtattgaatatcttccattttccagacactgtgctacagagtttacaaacatcagcattcttagttctcagaaaatagcataaagttgttactactattacttttatttcacagaggaaactaaggtagagataatttactaacttacctaaagtcaatcaactagtaaagtcacagatctataaatcagaaacaactctccattccactgactaggaatcttttttttttttttttccttctgtttttcaaagagacagagtctagctctgtcacccaggctggagtacagtggtgagatcatggctcactgcagcctcaacctttcaggttcaagcaatcctcccacctcagcttccccagtagctgggactacaggcgtgcaccatcacgttgagctaagaatcctgagctacgattccattcacagcaagttatagggcagagttttcactgatattctgcctttctccaaagattatgtatcccttcctttcctgtcttttattctcacggttactaccataattccagtctttttttctagactatttaaactgtctcctaattaacctacacgtttctcttctctccccatctgcatgaacattctctcttcttaagagatccacacggttgattgctatttgcttgactgaggttattttcaccctcctgtcagattctgcctactagagtagaaacagtggctgtccattctccttggttggacagctgactcctctgctatccaaattctcaatccctacttctccaacaccgtgctctctagcttccctccttccaagtcctgcttaagttgttaacggctacttattctttggagttcaagtaccactcatttcccagggcagctgccctgtctcccattcaagacaagttccccactagacttctgtatcataattgatctgtcataatgcttagtacaggttgtgaatattatatttattggtgtgattatcgatatgggtttgttttcccctctagaatttaagttccatgagggcaggatagacatgtctgttgggctttcaatgtatagtggcaaataacaggtgctcaaaaggcactttaaaaatacatgattctctgagcccgcttcctcatctgtaaaatgatagtaacaatgacattgcaacagtggcaaaacactcaaatgaaataatgaagaaaaagtaagtgttaacctatccggcaacaggaaaagctcaataaatgacaaccatttatggccacaagaaactttccacatattacatttaaatgattgttttctctcttatgattcttcccaatgtattgttttactccaacaccttgcaaattgcttaacacatatttagtcttaataaataaatgaacactttgacatacataataccatattattcatactatagtcctctaaggtaggcacacagattattatttctgttttactattatggttcagaaacgtttatgtgttttacacggctcttaaatgatctagtggagaagaagacaaatctcccaattatgactcagtttatttccattacctgtagaaaactaaagaaaacttacaataaaaataattataaatattcatatgcaaaagtacatctaaaatatacaaagaagaataatttagtaaaaaaactaatcaatgtttggtcagtaacacttttatatctgaatattaaataaaagtacatttgaaagtattttggatgcattccaaagctctaatacagaggataggttctgttatcactaaagctgaggtctctagctctacagttggttccaattctgcaagtttatgtgaattgaaccccaatcttctgaccaaatcatatttctcaggaaagcacaaattgttgtttcagtaaatatatagggtacttcacaaaagaactacacacaaggctaactgataaaactcctattagcagttgtttagggacacttatcccagttatctgacgcaaatttaaaaatgcaaaatatggcctttgggcaaatagaagcataaagcacatattctgaacgactaatcataatgagaggggaaaaaactgattccggttctgggttttggtgttccacacacaaacaaaaccaaaaacaactattcacaaggagctcccttcatgggttcattaaccttcaccaatctcccatacataactaaaaaaaaaaattttgttgtttttttctgagacagatctcgctctgttaccgaggctggagtgcagtggcataatctcggctcactgcaacctctgcctcttgggctcaaacaatcctcccacctcagcctcccaagtagctgggactacaggtgcacaccaccacttctggctaatttttgtattttcagtagagacagggtctcaccatgttgcccagactggtctcaaactcctaagctcaagcgatttgcccgcctcagcctcccaaagtgctgggattataggtgtgagtcattgcacctggcctaaaagccattttttgtttgtttgtttgtttgtttgtttttgagacggaatctcactctgtcacccaggctggagtacggtggtgcaatctcagctcactgcaacctccgcctccagggttcaagtgattctcccacctcagcctcctgagtagctgggattacatgcacgcaccaccacaccgggctaattttttatatttttagtagagacagggtttcaccatgttggtcaggctggtctcaaactcctgacttcgtgatccacccgcctcggcctctcaaagtgctggaattacaggcgtaagccacggtgcctggccctaaaaacctttttaactcttctttccccttgttaatttctggagagtatagcaagatttacaatatgaattatgaaattttaaaatattttaaaatgcttaatagttaagtacatgacctacattaatattaaattatagaaaaagctagtcattaacataagcagccactcaggtgtggtggcttaaacctgtaatcccagcactttgggaggctgaggcaggaggatggcttgagcccaggagttcgagaccagcctgggcaacatggcaaaacccggtctctacaaaaaatataaaaattagccagtatgtacagcggtaaaagaaaatgcatcacaataattaataaaatgctctaatggagggaaaagaagaaatttttttttaatttttctttttgagacagagttttgctcttgttgcccaggctagagtgcaatggcacaatcttggctcgctgcaacctccgcctcccaggttcaagagattctcctgcctcagcctcccacgtagctgggatttcaggcgcccaccatcatggctggctaattttggtatttttagtagagacagggtttcaccatgttggccaggctgttcttgaattcttgacctcatgtgatccacctgcctcggcctcccaaagtgctaggattacaggcatgagccactgtgcctggcttaaaaaaagaaaatttgttcttcaaagacatttctatcctagcagggaatagtggctcatgcctgtaatctcagcaatttgggaggccgaggagagcacatagcttgagccaaagaccagcctggacaacatggcgaaacctcgtctctataaaaatatgaaaaattcgccgggcgtggtggcatgcacctgtggttctagctacgcgggaggctgaggcgggaagactgcttgagcctcagaggtcaaggatgcagtaaaccatgatcataccactgcactcccagcctggatggaagagtgagaccttcatctcacacacacacacaaaagacgtctatcctagtggacgaaaatctggaatagcaaattatctgtaatgaatctgaaagctaattattccaggattgccatagaatacactgcaataaacaaactaatggcttgctagcattgtggatgcagagagtgatcttataaacatgaccaaaaagatgaaacaagcacttttatataggttgtgtatgatatgctaagacagtacttcaaacattgccacaaagactaaaaaactcacatgatagtaatggtgattaagtcagcaaatatctccctgtataattttcagaatttatataatactgccttgggagaagaaatcagcttcctaactggccacatcacaatacagcttgagcgaaaaaattctgcattttttcttgcacggtggacaactactaagcttacttaagaccagcatgaactacaagactacatatcaatttcacttgtacttgattacaaaactcatctatgacgaatgtaaaagaatatccacctgttgtactgaagagttttgcaaccaagtatcaaaaggagacaaggaagaggtgagtcagaaagatacagaacatgggtcaaaagatctacggttttaaacatcccacaaaaaagctttattaacaacctaaaacgtctatctaattctgaccatgagagtattaatataaatctatagttttagtaaggtgggtatgttttctccatttatacaaagaaatacataaatctaagtctgaatgaacaatgcacacagaatttacatgctatgattatcagtgattataaaactgattataaatgttaagggtccacaagcatgttaaaccatagtgcaaatgtcactactcctaatgtaatagtaacagcagcaaatgagaaacaatgaagttattctgtctccttaaaaaaatctactcaaacattcatatgatggaaaattatacctaaaagtatgtctcttatttggtggtaaccagaaaattaaaaattaattaacaattcaaagaaaggtccttacatttgtctaattgtttttaatgtcatatgaagaaatagcaagctggtaaaaaatgattattttgttgtacttaatgtgttctgaaatttcttggtgtcttctcaacgaaaaaacacattagatcttataactgagacaggagattcgcaagagcctgggtttgctggactcactaaaaggccaggtaccattggtttaaactgcaggcaacatggtaaaagacaaaaagctgggcaatttaaagatggttaaccacccctcccctccccccaaaaaaaaccttgagaaaaatgttatgaaccaaagaaatacatcatcttcacaataaacacatccaaaataatcgaaagagattcactgggaaaagttgacctttgaacatcaaatgatgttaaaaatcaggagatttaaaacttcattttataaaacgctatccctccatccactgacaaatggataaacaaaattcagtatattaatataatgaaattttatttggccataaaaaggaatgaaccacggatacatactacaacatgaatgaacatgaaaaacactaagctgagttgcaggagccagtcataaaagaccaaatattattattccattcagatgaaatgttcagaagagggaaatatgtaatgataaaaagtagattagtggctgccttgtgggggatgaggcttagggtgacagctaaagggcatggagtttctttttgaggtgataaaaatgttcagtgataactgaacctaaccataaatatagtaaaatacagtgagtattttaaatgggtggaatgtatggtaagtgaaacatatctcaatcaagctgtttaaaacagggaaagggtgggaggaatcccactgccccacctactttcttttagtggtgttaaaaccatttaatcccataagatatcattccccaggagacataatgcagcacatcttttgcccagtaggtctccaatacacaaatgctaagtgagttaatacacggacggtgaacaaagaaattttactgttgcttatatttgaaaatcctttctactttgaaaatattaaaacctaatatatccatttaaaaatccactgccatttttctatccggaaaaatccagtacatctttcaaatatttgcggggcaaaaaagcaaaagcaaaaacaaaaacaaaacttctcagttatgatgctcagcaatattaatatcaaagtattaaaaaaattctaagataatttgttaaaaattgacaatgctgaattctgtcatgtataccagcaaaaaaaaaaatcctcaatttactgtgatgaaaaaaattatttcagcaaaagccaagatacaaatttggcttagggggaataggcaaagagggaaaaccagaaacttctgggcatatgtttatatatgagtgtaaatgtttctacaactgtgtgaatatataaatacaaacagggagaaagggacacacacaggcatataaattttcccagacagagatccaataagcatccatagtcattacctactatcacaacctactatcaatcgatataagaaaggccccatttaaataatttagaagttcagagtaaaaatcaacagcgggatatagccaattatataaggaaaatacccatgcttctatggcatcaaagcatacgcaagctttggagtgcgtgtgtgtgtgtgtgtttcaattaaattaggcctatgataatacatgcgattttgttaggcaattagtaatattaaagaaacatgaaatgaaaaggcatttcaatttaggcaaaaacattttattttcttacctaacatttaacaattaagatactccatttattgcctgtatacttacaaattttacaggctacttaggcagctgtaataacataaatagaaagtaaatagtccttccatgaacagacctatcacctaattgaaaataaggggttagctcgccattaaaaaaagaaaaacacacattttaactcagtctatatttaccagaacacctaactttatagaaggaggcaaagcacttctcatatctgatgatgctaagtaataataatctcatttcatcttaatgttgaatcagcaattttgtattccattgatatatattttattcattttcactaatgcaatttgaaagatggtaatgtgattacatttctctgtggcattcatgaaaacaattactaatataatatgatagagaagacattaataaggacaggatttataatgagatgcaaaaagacttataaacctttaagcactttacaaagaaactattcctcattaagcaagaagcaagacaagatgaagcttaaattctggtatgtttcaaaagcacctccaatcctagaaagaacaatcgatttgcatgattatcacacactttggtgacgaagcaaagatgtacagaagtaacacaaaagttgtcccaagttgtgccaaatataacacctcatcctaagtcagtatctttcccttcccagatgcaatgtgaagggctccctaaagaaaggagttcctctaaatctttaccctctttataaaaggagctgcccaccttatttcaaatgccaaagcactgtaatcaatccatttcctaagcaagagcataggtaggtgaccttttaactaaatttactcctctaggtttgtgataaaatttaccccagtaaagcaacaggggagaaaagttgttacgttttagaatttaacatttcagatgacaactgattacccaggccaattgagacagactgtaagactaataatatcccatgtttgtacagtgctatgaagcttgcataacatttcaaatacattcttgtatttaatcatcaaaatccctaaaattagagattttttcaaacagcagaaaatgaggctctgagatgtccctaaatggccacagctactaatccagggctctttctactcagcctgggcatgggaggaaaggagcctgataatcccccttgttcccctcctcctcaaacaaatctgagatttcctcagatatgttttcagttccaataggagcttataaccaaataggagatgtgaacaaaactacacaaaaagggagagggatgggtaaaggtttaagcaacttgaaaagtgaaaatgctaagtaagcagttaaccatatatactaggattttctgccaaaaagtggtacacttttaaataaagaaagtgacccagcacagtattttatagtctttatatggttatattaagaaatgtcaaaatctgaaaacagtgagacaagatattcccaggaacacttggtttattctacagcattttacttatacctgtcttgggactgtccatcagcgacacatctcaacaaacattttaataccttctattgtacatctaactgtgtatcataattatctctgattataaaagaatatgtttcttcacttaaaagcaggtatcagcaaaggaatcatacctgttacaaataataatagtgatatgatgaacagtctatgtgcccccttatacgttatttatgttaggtcatagattccccaggggtctgtgctgagacctggactggcttcattagcgcttcacataaatcaatgaaggcacatcttgattttaccagtggctagagtcactggaatttttcaagtgaaacctctcaggtaatacatttttaaaaaacacaaatacaatgttaccatttcttctaaaaggtggttttctcaaattcaaagggctaaattcatatgctcagagaaattccacaaatttctatgacatctatatgaatctgaaggtaaaatgtgtgctagtatgctgaaaaaaaattattctcttttttcttttaaagattagatggtttttaaaaacagacataaagagaaagacaggaaaaaacagactgactagctaaaaacaaatgcttcaacatcactgagcaaagcaagagacctatgtaatggttgtcaggaactttgagctaactcttgaaaattaagaaataaatacaaagccttgtggagaaaaaaaaagtcttctagaacaacgttaatgtcatcttgggcatgtggactgggttcacatgtgtgtcagctgaatcaacataatgggctataacagcttcgaagcagctaatatggtccattgggtcaataatccgtgaactaagaaggatttacttgatagactataaatggctcgtaagaactcaagaatcactccatcagatcaaaaatccaattttcatatggtgcctttctacaaattagtcaaaagaaagtaatggctatgaaggactttaaggtttatcagctacaaattcatgttttaaagaacagtgtagaggaagaaataaaaattaaacatcttggggcaggggagatcaacctatttaaggggaaaaatatattttctgaaggaaagctaatatacagtatgaaatatccaaggggctttttatgttttcctataggtacgtgaatgtacaaatacaaaccactaaaatacatacacatatacattcatatttttctctctctcccctccagatatctacacacactaggtaaattgcaaaacccgatttctaagatagcaacaatgcaaaatgaaaattcgtattttatttttacctctttacaccatttgtttgtggatctatggagacatttgggacagaatatggatactggcaaattctttcattttcacttacagagaagcaggcagaagaaactacaaaaggtaaacagtaaaaactacaatatattttgaacatttaagagaaagaggagagttgattccctggctggccaacgattatacagccagcattttcagataactgcaacttctgccctctctagactgcagagaaacaggagcctttaccctgtgattgtgaatttcattacatattcatgctaggtgattgtggttgtagattaattttttaaaaaataagcctatctacatgaataattgtatttactaagttcatggcaacgaagaaaagcagagaaaaatactccaaaaatataacaggctgtaattagaattcttaacaagaaagaattcctttactcgggaagaaaatgtgatctatcacctctctctcaaaatgctattagcttctcttcatcataggaacaacaaaaagaaatcatttctttttctttttatagaagtgacactgaataaaataatggatgtttttacatcaaagtatattagctattgacataagctcggtcctcttaacttttacacaagggaaagaaaaattccaataattctgaactagacagataaaacttttctctgtggctacagccatgtactattgtatgtaactgcttatttttaaaaagagccttactggtgctctctgaaggattttcttttatacatagctttatcctataattttgtccctgttgggcacgctgcctaaatttaaacacaaacagtcaagcaatgaagaaacattaacacatttactgtgaacaaaaactcccagttgtacagtgaaattttaatacatttcaacttatcacttttactaatggggagagtacaaaccctgcaggaatttgctctgcaaactggtaattacagtagactcacttttttataatgcatatgtatagccagacaaaaaaaacgctggctgcccttttgatgtaggttacaatagaaatgtttttaaaaaattatgaaaatctacagcaattctaaaggaatgtgttatttcatggaaaagtgtcctttaactctgtatgtggacacaaatagacatatatttagatatttgttttacacatgagaaggcataagctttacctgcatgagcttttatgtcatttcccccataatcttaagtgtacaaaataaatctgctcctatttgtacaaagctagttgtgatttaaaatataaatttatctattttaaatataatttatttatttatcgtataaagatgatattctttcattccgtgcctggttttcggggcagttttgaagagttaaatccatatattgggatctcactgtaatttctcattaaataattaaggactgcaaatcagtaatttgtctctcagtccaggtatatgtgcttcttgatgaaagagaccctatgtgcatgcctgaagagtaagaaccatatactgtaatattcataatagtagcataattgatagaaatgaaataaaatctttgttactattcacatcacgtgctagacactttacatttatctgtcaaatttttggttccataacatctttctaagaaattgaaatctgctagactgctaagaagctatcaatatataatttatgttaacctcaggttttctaagtatgatctgactggggaaaaaataaaagcagataaagcttttaagtggacataacttttgtaaaattatgtgaattaaaaaataaaagtgatgaagttgctaaaatgtctattactgagtattatctacaaattccagggacaactttctaaaaatagaaactataaaattcacatgaaatatttagcatgtatttactagcagaatatgcaaaagttgctgttcagaaatcactgccttagtcatccaacttcacataagagagacaaaagataatcattcctggtaggcttggctgtggcagaatgaactcaccactacggggaagagacgttttggatacactagaaataagtaccttcttctaagtccacatgccttactattcttccaggcaacgctagtaacattctaaccttagatctccctgtcattatagaaaagcatatgttcccctccaccattctcatctctaccaccaaaggctacttttaccatactgtacctgaaacccaaaataggaaaacagactcatcacagcttaagaggcgggcactggctcacaggcagtgtatatatcctgggcaatacctattccttctacctggaaattaaatgagatgctttgcatttttgaaaaagccaaacatcaaaatatgtatttttcacttctatttccttaaagttggtttttgcacaaaatattaaatagggttgtgccttaaatatgaataaattaacaacaaaagtatacttcaaggacatgtaaaactttagtctctccaatatccattcacccatataaaaacaactgaacattaaaatgtatgtagcctatcacaaagcattcatcccttcatttgctaagatttgactactccaaagacaatgctagaaattatgaaatataaaaacataaacaaatatacttcctgctccctcataaacaaatatgcttcctgcctacaaataactgaactgtggagcaaagtgatttggaatatgagcttaatgtcaatcatattcaagtaatttggagagttaggtcataacttacatactacagagatttacaactttcataggatcaaaaggaaagaagtagaaattcaatactctctcttgctgcaaggcagagatggctgtgaacggaagcctaggtacaaaaacgtgtcataacaaaacacacacacccttctaacaccttcttcaaatgaatggttccctcaacttgtctttaagtaaaggtaaaaagcagtttgaggccaggcgcagtggctcacgcctgtaatcccagcactttgggaggccgaggtaggtggatcacctgaggtcagaagttcaacaccagcctggccaacacggtgaaaccccatctctattaaaaatacaaaaataagccaggcgtggtggcacatgcctataatcccagctactcgggaggctgaggcaggagaatcacttgaacccggaggcagaggttgcagtgaaccgagatcacgccactgcactcccacctaggcgaaagagcgagtctccatgtcaaaaaaaagtaatatattaagatatgcttaatactttcatacatctgcatttttcattgataaattgataacagcgcatgcccatgtgttgtggtgcttccacttcttccatacaagcaccataggacaagccaatatattatcggatgaccaaatacacacaaaccagctttgctggtctacgaagaatgataaaggaaaacaggggcaaccaacggttttactgtatcactcactcatatttaaaaccctgatatataagaaacctatatctagactacggtatgtactttaagtaatccaagaggggccctacattgatgaccacaaatactgctatttatgacactgaacatcagttggatttctgtaaagtaccttgtaagtttgtgagatggctgtttcctaccctatttgcacaattagtgtgttctacttgagtgaatcataaatagataaggaaagcacaattcaatatgatttttcactgaaacattatctgaatatccatagagctggtgataagcatgctttaatactttgatcatatccaataaatgtgaggctattattttaattgtcaaatatattacctgtgctcaagttgtttaacactgagacacagctgccagatggtatgtctcctaaaaaagtaaagcagacgtagtacaattttaagtgggtgtgtatttgtacagtattattttctttagatttccagtctattgacaaattcagcattttattccttaatcagaaaataacagattttaaagttaaggtatacatgcttcctcacctaaccatattctagctgaaaaacatcatttttaatgtttacctatatttaatatttcagttttgtgtttcaattagttaaaatagtaactctccctcccctaaatcaacctacttgttttattttaaaaaggtaatgatgcgggggtgcggcgggtggcgagagtcttctggtgttagaagtaatataaagagctagggttatacatgaataaagttagtttgtgtatgaaggaattacacctgagctagtaacctgaggatctctgtacacagttgtcaggtgtcctacctttcatctgaaataataatgcacaacaaagggtagaaatgtaaaatatgtgctaataacgccttcaatgtgaaagtgcctcttgctttaatttgggatcacagaaaatgatgatgatacatcttttattatttaaacatcttggaaggggcaagaggagtctgtaaattaaaggtgagatttatcacgtgctgcgaaaacaaggttccacagcacaatctcatcttctttagctatgaaccaaatgtctccacttccttcagcaaaagaaaactcttacctattaaatataaaaaagaacaggtatatgtcagaatcatctgtggtgctttacataagtacagatatccaggaccacactccagaatcggggaatcgcaacttccagtccacttgcacaacccgagaagaagtgcctcctcaaattttgtacctcgggcacctcatttggctcaccctactcctggccctatattgttaacacttgtggtaccagaagaggcagggaactgtgctgagatctaaacgaacagacacaaatgcaagaagatgctctgtttaaaggacttcaggggtaaagggaaatcccaaacttgtttcgaatcccctgggacattgcaagagaagtaagcagtttcctgaggagggcctcatgagcttttccaagatttgaaagcagagcttctcagagggagctgagtccaagccaactgttgaagcaagatcctactacacactcctgagcctgaaaatgatggagaggggaagaggaagccagggagggcagggtctgggtacctaaatggctatccattttcattttaaatggatgcaggagaaaagatataaatgattaatatgactaatcaattcccttagtaattcccttcctccccactgccaccactcactaatttttcaatacgcatttaggaaagtagagagattgcgtacaactggccgtaactgcagtcacacttttctataaccaggagtctggtaatatctctaaagtttaaaagataatgttctggaaagtacccagcacaacccctccaatataataagtgctcagtaatgtttctcttccctgtcttctacataatcgtcaaagtatggagccatatacagcaatcaagctttgacatagttaaaagttgttaagaggagggtaccattctgctttcataatttttgtcattctaacccccttgcaggaactaaatccttcactcctgacccttatgaatacaaagcaggttctttgcctaatttatggtaattgtaactgaactgggccaagtggctcccaaagtgatttctgaaagactaatatgccctcttctggtttcttatttaagaaaaaaggaaaacaaaatgttagtttattagatgtgtaaaaatgtgaggtaaaaatgtgtacttatttattgtatttactactaatcatcttaattacttcatagagattttcataggtaacttagtatttggaagtcccaacattaggtaaggtgaaaatactttctaatgacatggtattcaccaatggggctttggaaaaatttttcccaagccagatgacagcataaaaatgatataaattgcatgaacaggggtcagaaaacaaaaatctaaatgtggtatactaggaaaatctacaatgtcttttcagtggtgccacataccccctcagtgctccccactctatgcccactcaggcccgctttcacagccctgggccgagagcaatgccaattagtgtcagttgtgatggggttttggagacatggacctttgtcttagaggaagtgggctgcaaccaccaacttactgtacagaagcaacctaacaacccattaggtggaaatgacttttcagccacttcctccagggactgtatcagaaactgatggcttagacagatgggaacatttttacatttctgttttaactgcatccaggaacatggatttttatcatttgatgctgccaaaccctcatttcatctactgctcttttctatagtattccttgactaataaaatgataaactaaatactttagaaatagaagatgccatcttactgtatatattaaaagcattctatgagttatccactgaatttttgggaatttccgaaaacaagaaatttccttactggaatattgttctccaagtagcattacatgcttcgaaaagatgctgatggttaccctttatgcctccaattgtcaaaccagtaatagattaggttaaatctatcaagaagcaaaagtaatccttccttggtccaggaagcaatgaagtcaggcactgcaaacagaaatgttcacacactagcagataagtcagggccaaaggctttaatccagcattgtatttatgtggttacagagctaaaatcaaaatttacttctacacagtgtcaggtagaatgctaatgttatacaagaaaacttgtaaccagttaaaattacatttttcatattatttaaaacatatgattttaaaaataaacatttaatacacattaactgctaccaatgcaaatatttgttaaacttttaacaatcaggttcaccctaacatcacacaccaaaagtcacaaattttttgtctgtgtgcaaaattgctccattgaagaaaataattttgagacgctaaacatatagtacataaacactatttatcagcaataagcagctctcaaatgccataataaagactcaacaattagagcatcctttctggtctaagatgcttcactttaggcaaaactaaaaaggaggttgcaagtgccatgaaatctggcaataacttaaaacttttaacttaagatttttaggtaagcttcactatcaacatcccaaacctgctgttagtatttctgctcataaccttggctgattttattaatgcccagaaaaatatacacttttctttaattttttttctgtttaggtatattttcaaacctctctcaaatattctcttaaaaattaggtattttataaaaaaacattctgtcacagtactgcttaaaatgttagaaatttcatataaattgtccatttttttctttcctcaaatcaaaaagatacaaaagaatgtaaactctagtaaataaaactttacatgagtttgtatactaaataacatcctaaataataataaaagtctaaattttatttgatctggatgttggcaagatagatgttcaattctcttcgtattgttctaattagttcacaattttaaaaccactaacaactacctgcttagtcaacagaagtacaatacaaaccaatacaaagcaaacatctgggacccatcttaattagaacctctttctctctctctctgtaagagagattttttaaaaaacactttataaaagagaagcaatgccccattcatattaattaaatgccaacttttgtttaattttgtgaaacacagaactgctatgtttattttagaaaagctgcatgacataatttaaatgcaaagcaaaactcataaaactttaaatataaatccttttcaattagaaagatcttgagagacagatggctacaaaactatgctaaacctacgctaaaagccactgaattatatactttaaaatggttaaaatgggctgggcacggtggctcatgcctgtaaccccagcacttagggacactgagctgggtggatcacttgaggccaggagtttgagaccagcctggccaacatggcaaaaccgcagctctactaaaaaatacaaaaaaacacaattagccgggcgtggtggtgggcgcccgtaatcccagctacttggaggctgaggcagaagaatcacttgaacccaggagatgaggttgcagtgagccgagatcgcgtcactacactccagcctgggcaacagagagagattccaactcaagaaaaaagaaaagaaaagaaaaggttaaaaatgattaatttttatgctatgtgaattttacttcaataaagaaaccagaccttgtaaaacaagacaaaaatacttgtgggtgtcagtctgtttttgtgtgtttgttttagtaaagctaataaggctactgtaccaaacaaatccctccactctcgggaattacacaaatagagcaccaactttcttaatggacacatctttttcaacaatgacttcatgtgatgtcccctcatacacgccaaagaataagtcagtatttcaaaaggaacacaacattgtaactactttctgtaaaacacatgactagattgtgacctctatctaattcaccaacaataaattagtagagaatgaaaagaggaaattatcctaaagatttcatgttttcaagtatatatttctacttatttgcatatttcatatattatctgcaaagttaagtttaaaaatactggcaacgcttcttacgcacttactatcaagcagtgttctaaacactctgaatggacaaactcagcttatcctgacttttccctcttaggagggtatcacgctatcattatctcaattttacaggtaaaaacaacaacaaagcacagacattaaccacctttgccaaggcagagccaggacttccgatcaacttcactacctactctctaaaccactatgctttaccacctctaagcttcaacatttttctttaagtcccatgactactgttaagtaacaagtgctacataaaactgttttccacatttaagatggactgaatggaagcttttcttattgccaaagaaagaactcaaagtgacaacttcagaaaatatgaaatggaagtttattacagcacaacagagaccagagccatgaaaacaagcattcttagagttcagagtctgtgatataattagtgataactaataaagagtccaacctttcaagaattcttttttttttttttttttttttgagacatggtcccgttctgtcacccaggctggagcatagtggcacaaccacggttcactgtaaccttaaccctcccaggctcaggtgatcctcccacctcagcctcccaagtagctgggactacaggtgcacaccaccatgcctggctaaccttttcaaacccctggcctcaagtgacccactcaccttggcctcccaaagtgctgggattacaggcgtgacccatggcgcccagtcaagaactttttttaaacaagccatttagagtgcctgctgctagaacagaaaataagggcttacaatttcaattatgagcaacatttgagtcctaagtaagagaagtaattatagtatttataaaccagcttacatgtatatttagaacaatgacttaattcaaacatgtataaaagacaaaaacttgagagaatagaaaaaatattttttaaaggattagctttaaaagttaataataaagaaaaaagttcactctgtcagagactctgaggaatggattagaggggagaaatatataggcattcaattttatttattaatttatttatatggtttggctctgtgtccccaaccaaatctcatcttgtagctcccataattcccacatgttgtgggacagacccatgggagatggctgaatcatcagggcaggtctttcccatgctattctcttgacagtgaatgggtctcacaagatctgatagcttttttttttttgtgggtagggggacggagtttcactctttcacccaggctggagtgaagtggcgcaatctcagctcactgcaacctccaccccacaacgttcaagcaattctccagccccagcctcaagcaattctccagcctcagcctcccgagtagctgggattataggctcccgccaccatgcccagctaacttttgtatttttagcagagacgaggtttcgccacgttggccaggctggtctcaaacacctgacttcaggtgatccactcacctgggcctcccaacgtgctgggattagaggtgtgagccaccacgcctggccggcgatctgatggtttttaaaaacaggaatttatctgcacaagctcctttggcctgcggccatccacataatgtgtgacttgcttctaaacggactaacacatttattgaggcagggtctcactctgtcacccaggctggagtgcagtggtgtgaccacagctcactgcagcctcaacctcctgggctcgggcgatcttcctgtctcagcctcccaagtagctggaaccacaggagtgtgccaccacacttggctgactttaaaaaaaaaaaaaatttatagaaacagagtctcaccatgttgcccaggctgatctcaaactcctgtgctcaggcaatcattctgtcttggcctcccaaagtgcgtgagccacagtgcgctgtggtatccagttttaaaaaggggattcgttttgataaaagtaatgcaaaacctcagagaaagaaaaaaacagacaacaaggagagacggagaaaataattagggaatgtagaaaaaaaggggtggtcttatgaagtggcatttaaaagaaacacaggaccaagtccacacttgtaaacttggctgtaacaattcaaactcagtggtcctttaggcaggtggttaaactaaacacgtctaaaggaaagagttttgataacggctacactttagggtaagtaaacaattttattatattcttacagaataaattttcaaagcaaaaaaagttttggttttcctactttaccaatcttgtttaaaataatacacagagaaattaacaactctacttgaacatagcatagtgtgctaatgtatttgtatatgctacacggatgctttcattttcagatgaggttcattttaagtctttttgaaatctaaggtgatgttttcctaccctgtctaggcagttaagacttccagatggaaggccccttaatactgtagttccaactctagtgacctaacttatagattaacaaaattgatctcttttttaaaaacacaaaacaggcaaaataaatttgactctcctgaaacattaatgtgtgaacacagtttttaaagagtaagacagggttcccaggatccccaatttactcttatgaccaatatggagttccaggtatccaaaaacccccatggtacaagcatcagtcacactgccagaagggaccacaaagcactgtttaaataaagccttcaagaaatttgagacatcaaatttacgtcaggggagggcaggctcaaaaagagtagaaagcttgtgattaactaaatctacccttatcctctactttccatgagcagaaaaagattccttaggggtacttcctacttcctatttttaagttatttattttccctgagaccccaattcctcacttgtaacaactgaatggtactacttttcacacagcaattttgtacacattagaaatattttgcttaaaaagctaagcacagtgatagacacagagtaaatggtaaataaaaacgtttcttccccctccctctgtctctgtacaggggagcttcttttttctttcttcccccttctttcttgtctattaaactccctgctccttaaaactaaaagaaaaaaaaagtttattatgattattaattcttagacaaaataagcatttaaaaataatcaattttttaaattttgttttaaagagatagactcttgttgtgtcactcaggctggactcagtggcaagatcatagctcactgcagccttgaactcctgggctcaagggatcttcctgcctcagcctcccaagtacctgggaccacaggtgcacactgtacatttccaaaatatatggctcccagacatacactttacatgttaaaatatgccctaattacttaatagataagttgatgtcatgaaaagataacctgacagggagtcagtgagatctgaaaaatagaggtactgtttccaaagcccggcagaagcatgcaaacttgaaataggcaaaagtcaaactccacttcctcttccattacatgcataagtttcaatatgctcaacatttcttcaaagctctaggtttccatattttataatgtttttattatgtacttaaggttcctaaacatcataccttgccaacctaagttcagtctcctgtacaggaagggatcttgggatttttctgtgtttctttagcacctagaacacagccttgtgaaagatgcgcaacatgggctgtttgaatgaaaggggatacagcaggcttggctaactctgatcactgattgcctagagaaaagtgcaccccaggggacctttcggagccacttttcaaaggctcagagagcttttataacaaaagtctcagacatgaaatcattactacaacaagtattttgtgaatgcctactctgtgctggggattgtatacatagtataaaacccacagtatcctcaagaagcttgagctgcaaggaaagtaaataagcaatttccaatagagggggggaaaccatagggtgttatgatatgaagagaaggcgcaccaacctagtcttgcttcatggaggtgaactgagataggaatctacaggcccaaaggtgaaagcttgagctgctccaggacaacaaaaattggagctcagctggaaaacaagctaaatatgagcatatagaaataactgctaaaactgtgtccagcctgctaaggagaagaccgaacttcatccttgtatctcctatgcttccttatgttacaggtaataaaggtatgtagaagatggctacaaactattcaggtacctggacagcagaatcccaggagtgtgctttatggaatttatctatgggacatatttctattctagttcttaatttaaactaatctcaagaaaggtcttctctgctggacttccagaaagatcactgatctttttctttttgacaaaactgttgctcttcccccttgtctccagtaggtcttgaatcccttacctgcccttcttacctttcccttggtaccccctcctctcaggactcctgtctcttagtatcctccattttgactgaattgacaatagaagaaacaggtttggctttgttttgctcttattcttctctgccatcttctgtctgataatcacaagctcttaagaaggcaaatcacttatgtcccttaataccaaatcatttgtatctcatccatattatggataaatataccattatttccacaaattctaaaggaaaggcccagcaacataatatagatatcacacaatgcagtgatgagggaagggaaaaggggtggcaaaaactgggcgcaccatgtaaccacaaccagaaggataacagtacaaggcaatgtacctaataacgcaactgaaggaggattgctgaatccgaagcattttaaattatgctcatagagtggcatttgggagccccctttgctcatctaatggttttcatgcctgccagatgcaccactataattaaattcagtaaaacttgaaaggaacggccagtgagtaacatctttccttaaatacccccagaaggaatccgaggttcccaacaatgtatgtatgacaagaaagcagactacagatacaagtttgaaggaatgataaactgacaaaatatttaaattactataatttatcagggttataagggtctatgaattgaaacagagataggtagtctctgatcagttggcccaacagaatttaaacgcaatcagtgaagaaaatacaaagtagatcttaaaaaactcctatctgcttttaaaatgtcatctaccctgtggtaacttaactctcattctcatacatggtatttcacctttccttgcttcacagttgaagaaacgcaacactcagaagatcattaggtacatggagtctttccaggggtacaacatcatacacacacttaaaataattagtcatgagtgcatacccattttcaagatgacgtgtatatagcaaattctgttgctccctggcacttaaaagagttttttaatttgtcatgataaagcaaggagaaagtagctgtcacttaggctgccactgctgtcatactttttaataatacagctcctgtaattacactgcggttctttatattaactcagtgaaagcttgcttggttttagcatgaaaacaatttatgaaattatagaaacagactgaacacagcagttcatttgttgaagcaattatccagatccttgtcaaaaaaaaagtacaagcaagagaagactgtgatgtgcaaaaaatggttctaattctatgctttaatatgtacaatatgtctgtggttgtgctgaattatgttaataaactgcagccgaaatatatttgttacaacacaaaggaaaggcgctatcaatcgtcctgccagatactttaaattagtcaccaaagcatccatccagccagagttttttctataacctgcacatgaagggaagggctccaggatagttttctaaaggaccagatggatttttctagtattttgaattatctggaaaacggctgtaaagtgaactgtggcacaaatgccatttttaaatgacacataaaaatccaaccctggacatcaatcttatgttattttttgactggttatcatacaaaaatccaggttcccaagcagctcccaagataggaatttagaatacttgttgctgaaaaggtgaggctaatagcacaatcaagtgatgccagagctattgtttaaatgattgcataaagaacaacaacaaaaaaattcaaggtaaaaaaaaggtctcactttacactctgataaagcaagacatgcagtctgttagcattcagccatgaaaataataacttgtaagaccagcttgtaaggctatgccatccaagtttcactaaatgtgtttatcaaattctctggaataatgattaagctcaattttaaaatattctacctgcagagtaaaggaacaattcttgatttaacaaaatttttgaaaattcatatacaagtaaatttatcatataaatgtctccaaacaaaataaataactcgaggaagaacaaatattcctccatataaaaataacctagtctctttcttctaactagaccacctaacttcaataaaagcacattactaaatgtttcctttaaattattctattagttaatttgtaagaggtagaagagagaacagagatctaacactaaaataaataactagaaaacagaagcaaaaaaaaaaaacctctaagctcaaattgtgaattgtgcaacaaagtgttatatgcaataaaatgtggacgtctttctttctccccacatctggagatagtttagtataccgacttccagaaaccatgcaatcctccagcctgactagcccctttcattcacaaataaacaattaatagaatgggcaactaattttccaagtgttcatattcattaggctgtttcctgaaattaagtatctgcctcatgatacaatactgtacacatgaaacagtctcacacacccaccccttccccagccactttctcataccaaacttagagaactaggcattcatatttccattttccatccttttattagagtagaatttgaaaattaaattcccttaactgtactgaataagaaatacaaaatattatatgacaagatcccctcaccaattcttagcatggatttttattcttgtggccccatcaattcaataaatatttatcaaatacctactatgtagaaaacagaattctaaaccctgacatgtaaacataaatatgtccttgaggaatttacaactgagtagggagataaacctgaccacaaataactatactataaagtggaatgtgatcaatgtgacaagacaggcataaacaaaatgctttagggttcaggggagacagactacttctattgaggtaatgagaaaaagcttagtgaaggaagtggtttggaagatggataggctttcaagaggcactggactcaaaggtcctcaaggtcagagaccatgtcttgttttacttggcacccacacatatctcctagctcagtgctggaccatcatcacttatgacaaacctatttaagtgatttcaacaagccaagatggggaaagaagatcatccaagaagatggacaagtactgccaatggtacggaggtaaagcagcatggggcttgttcaaagaacatatgagttatagcaaggagaatacctaggaccataaggttagaaaggtagtctgaaaaatcaactggatcaaaataaaagatagcagtgagttttattttaaatttgtgaaccatggggaacactgacaatttccaagcatatgactaattattagagcctgtatgcctattgtgccagtttgaataagcaaatacccagtgtacttttccaattttaaaatgcagatcacacaagggaaggaaaacgtactgtgttaaagaaataacaagaaatatgcaaaacttctaggaaaaaaatccattttgtgcttgcaacccagaaaaatgttgctttaataaattttaaatgtaaaagacaaagtcaaaaggaaaggtggccccaaatgccacatgttattgaaaatcactggggacagcaggttatggagtattccccattactgctgtgcaggcttctcagaataggtatttataacaaacgccaacacctgtaccttttctgaaaaggagatcagctactaccttcatttttcaattactgagattgtgcgcaagaagatccccctgctacttttcctgagtgacaacaggtaaatgtaaggaggagcctcttagacctcttaccataatttgggcgcccctgcatccttgaatccaaccaccaattcagctttaagtgagaaatcctgggtaaccaggacagcagactatgacaattccctgggatttcccagaagaaatagtgacaagcacagctgtcactgggcatgtcatggaagactgcaaaattttctgagttgtctctgattccagacaggcagtgtattttcaattaattgcctcgatgacatcatgagacaactcgattacaaaagaaaggtaacagtcacaagagggagatgagcagtaccatatggataacagccacaaaagaaaggaatgaaaataagttgttttctggtttgtgtgtccttggagccaaacctaatgaaacaaggctcaaaaccaaattacagcatgtcctatatattaacacttgggaatgaaattaaccagaaattaacgcttgggattgaaacccaaaaatgttaaatttcactgtcacaagcctgaagaaaaaatacaaaagcaacagacgtaggggtacaccctgagatctacggaagaacttctagtagaaatagttggccattggccaaaacttagaaatctttctataatattactgtcataaagaccttattagcaaggatgggggtcttactcatcacagcctccaaaatccaagacagtacctagcacagagttagcaatcaacacatgtatgcttcaaaagagaaacagattcagtttactgtgattgcttttgttttaaaagccaacaaaaccacttggaaaaaccttttcttgaaaaaaaaaaaaatccaaaaaactccatctaatccatgtaaatgccttcactatcatggtaaaatgcaccttttctctaaataaaaagaaagcaaggttagagtttccaggtactatttaaaagaaaggtttctggggtattgttcccttttatacagtaaggtgatatggaagagctacatgcatgaagttaaaaaaaatggccaggagtggtggctcatgcctgtaattccagcactttgagaggctgaggcaggaggatcccttgagctcaggaattcaagaccagccttggcaacacagggaagccctgtctctacaaaaaaataaaaataaaaataaaatagctgggtgtggtggcacatgcctgtggccccaactacttgggaagtcgaggtggaaagattacttgatctctggaggtcaaggctgcagttagctgtcatcgggccactgtattccagcttggatgacagagtgagactctgtctctttaaaaaaaaaaaaaaaaaaaaaaaaaaaaaaaaaaaaaaaaaaaaaagccaagcaggccagttacctttccacatacaagaacagtctgcagacacaccagcatgccccaaattaggcaacatttactgctaagcacaaggaacactgcttgcaagagtgaggatacagcatgataaacccattattattgccataattaacgaatggtgggcagctcataggtaatttagcaggtaagtttacaattctgccccacatcttcctagatgtcataattttagagtcagcatttcttaagctcttgatatgtgccaggcattaggctaaatatttttacattaatgttgatggagctcaggacatgctaccccaaaatatggcaccttgacatactgaatatttaagattaagagttttgagagatgatatatgcaaggactctctgacatttccccatccttttccccagaagcaggccataagatcgtcatgtgagaggtgcccttcccaaaacccagaggaaaaaagcaactgtatatctgaaaatggaaggacatcaaaaggaatctaaataagaaggccttgctacgtttccttcggtttactactcttagcacatactcttttttgtcttatcacatttttccaggactgtccattcttcatcgaacctataaaaacattcagctttaattgtttcctcaagtcttcatttccttatgaaggaaatgtgtcacataaaatttatattaaataaatttgtatgcttttctttgttaatttgtcttttgttacagagttagcagccaagaacttagacgagtggaaggaaaataaatttttcttcctctataatgtaaatacttcacatgcatgaattaatttaattttcatgacaattgagcatgattggtactattatatcgccattttacagataaggagactaagggtcaaggagattaaggaacttgactaaggcctcatagctggtcaatggaaaaagtggaattcaaaaccaagtctgagagctcaatggtcacatttgttcaattccattacatcaagataactccaattaagctgagaaatcaagcaactgtgtccagttgataatgtttccataaccatattgaaaatgttccgggccaggcatggtagctcacacctataatctcagcactttgggaggctggggtgggaggatcatttgagtccaggagttggagatcagcctgggcaacaaagtaagacactgtctctacataataaaaaataaataaattaggtgggcctggtagtgcatacctatagtcccagctccttgggaggctgaggcagcaggattgcttgagcctcggatgttgagactgcagtgagccatgatcacaccactgcactccagcctgggtgacggagagagaccctgtctcgcaaaataaaataaaataaaagaggccagacatggtagctcacacctgtaatcccagcactttgggaagcccaggcaggtggatcacttgagcccaggagttcaagaccagtgtgggcaatattgcaagaccctgtctctacaaaaaaaattttttaaattagccagccccatggtctcagcaacttgggaggctgaggcaggagaatctctacttgagcccaggagatcaaggctacagggagctgagattgtggcacttcactccagcctgggcaacagagtgagatcctctctcaaaaaaaaaaaaaaattaaaaattaatgaatgaaagaaaggaagaaagggggaaaggaaggagggcaggaagacagggatgggaggggaggggaggaaggagggaaggaaggaaggaaggaaggaaggaagaaaggaaggaaggaaggaagttctactgacacgtgggaatttcgtaggtggctctctatagcatttcatagtatgttctttcctcttgttttgaaccattctgtcctagttgccaccacttgtgcaagtattattacatctttgaggaatctttaaaaaaaatagttgccacagataatatgaaacccagttttgtgaattacaacaggtaatttgtgaaaggcttaaatcacagtgttggcaatctggagtaactattcagacaaccatataatgcatttgagaacacagaaattgatatggggtcatgatcatcatcgataaacgtaaatttcagtttactgtcaagtccactttaaccgtggccctgcaatcaaaatgaggtacttcttatagaacaaacaaacaaacaaaaaaacctacttttgaactaaacttgattatcagatatatcttcttagccacatgtaaattgaaaattaatcactttggttacgaaaaaatacaattgaaaacatcattctatgacaaattatacctgataaagaatgtatcacccaaagaaaacaaagcggaatatgaaaagaattatgaaaatggccctatttttagttcaaagtagagtttcctcagctacactgtcacccaagagaatccccacaaagccctgtagagccagctcctccaaattttacgtacagatggaggaaaaaaaaaaaaaaaaaccacgattatctataggagcttctatacaaggcacatataagtatggtttttgtggcaggcacaaagtttagtaaaaccttggggccttaatgaagggtcaggttccaggggttaggtttcactaatggttttctgaagcatcagcagctctcagcacccagttttattttactacataaacatgtatgcagcatttattatgtttcaggcactgttctaggcaccatacattcattaaatcctcacaattaacttcagctatgcaggaagtaggtattatcccatttcactgatgatgaacttgggtgcccagacacttcagaaacctgtccagtatcacagagacagtacaagtggtggaaacaggattcaaacctaagcagcctggctccacagtccatgttctctgccactgtgacatgctgtactttcccagcaatggcagtaaagccatgcctggactgaactctaaaatggagcgccactttacggtgactaaaagcaactttcggggctacctattctacgtgccctcactgacagacctgtaacaatgccatcaataatccctgatcccatacccaatggaacgccagctaccctctcagtgaggccagtgccttggggactggttggctacactggctctgtgacttaaaccagatcatctggacaccttattctctgagctgggttatccctgaaaaaaaatgttcaggttgcatttaacacctcttctctctacccaattttagctctagagctattctacgtagatttcagttcattctataacagcatagagaaagctatcctgtggactgctttttagatgatgaaccttctcattaccagaatctgttcacgggaggacgccaggaggaagaaagctatatcgagcatggccacggactagggacacaacatcaaacatcatgttcagagctctccctttatttacagaatgcaatcagcagcaagatctgtaaatttcatcttcaaaaaagaggagtaggacttcacattacagtacttaatataccctaggataaaagaatctacaagttctccaaaactatgaatcaaagatcaggtggaaacaaggagtgataacaagaggtccagaaaggacagatactcatcctttccacatgagccttgattgcacaattacttaagttaagttatgcattctcagaaaaccaattaattgtgctggtgctctctgaagctctaacaccggctttgtcaacagctgagtggtttcataaaggtggaggacaacagttgcagctcaaacagtcctgaagctctaagaaaaggcgcccttctaaaactcaaacgactttcaggaaagaagaaatgaaaatgatttgtcaccaaaaatattcattttctgacatgggaacaactttagctaagtcaccaaatttaccagcatttctataagtgaagcaattcaaagcattctttattgaacacctaaggtatgctgggtgcaaagatcactaaaaccaagaatctaagggctctctatcccctggggacttagagtgagagagggaaagagaataattcaagaaaattataaaaattccaaggaagaggtgactctgttcaggaggaaaagggaaacatgaagccaaaattcctggttaaaatattcacagaaaaataaatatgtacaccatcaatgtttttctcaagaatacgaaagaagggagcaaggagaaaattcaaacccaacataatgctttagaaaaacaaaaatagttttctttaaaaacaaaaaacaaaaaaaaaataccaaaaagcacccttctggcacagcaggcttcctgtgattgcagagtgaaaactgtaccataaaaatccagtccacaagtgccagaggaaaagaaactttccccaaataacaaaataaaaataaaccttcagttaaaataatatattacacactgatgtaaactgaaatgctcttgtccatgggttgagcttatgaaacccttaaacatgaacatgtaacactaacaaactatttgacattattatttgggttcaaagactccctttctctaaatgtttatagcaccataccagttatttcaactgagctgacacaatgaatttcaaatgatctaatacttttgacttaccagaggattagcacatgattaccctgagtaaaaggattattattactgctgctctaagatattaacactttctgtaacacactctaagggcactgtatagatcactgaaaaatgtgacaaaatgcatgggggaaaggggattttaaaaaagaaaggtggtaagtgttcttctcttttaagtttccttgcttaaaatacagtgggcctcccaacggtagaatcaacattttgcatgatgctttcagtggacatacaagtcacagaaaaataagtccagcattcaatgcactcaggaaattaagccacgtatggccttcttcccgtgaagatcaggctccaaacaaaaacccccactttgtaatagacaactaattctcatgtaatgaatgacagaacacagcattaatgtacttaacaagacagagctaaattcaatgaagcttgacgccattgatatgaaaaagggctacatttgtagacagagccaaagggagagaaaaaatcattctgaattccgagttaaatagtgctgcttctgctttggtttagccctctcactggaaataaagatcagagctaaaatatgacccttaaaactggcagcagcaaagaaagctaaataccactgtattaaactctcttactgactgacaaagaggcaacagctaacggactttgctcggagcttttactggcaaaagtgttatttcttcatggctaaattcctgatccattaaaaatgtgccccttcactaccagacttcatgatatgcaattctgccaccatctgatatcattataaaaatttcagacaacccaaatgatgacttagtagctactgaaacttctacatacagcatcaaaacaaaagatatggaagcaaaccatgtgacacaaaatgagtatgtagcaaagtttcttatgtagagccaccataagaaaagatttgtaaaagcctataaataccatagtgccaactcccttttttcagtgttaagtgcagaaaacagattttaaactacattttaaaattcagcatatgaacaatgctgatcattctgaaaacaatttataaactataagtagatgagtgaatatttaaactccttgagcaggattacagtaagaacactgatctaaatagcacactttatgcatctggtgatatgacttatttctgtaggatgttcttacacacacagaggtaacaccacctggaactgctataccttaaggcagggaaacctcgactttccacttctctcctctatccacaatgttatctggttccgctgttgtcacagagccagggaataaagctcttccagaaaactcacccaagatcaaattgagcctggtgacagcaatgtccaggccgtaagtaatgttcaaaggattcaacaacgcctgtgactgatcattctttttcccttgccatcacctgctgattttgtccaggtgttttatggctatcttgaggatctggagagcagacagagggaagactttgccaatttcttttgtctgggattgtgaattccttacacagatggtggacagcctcagtccagggcagcaccagggtatactgccttcaacctccaaaaggagaaacagagggaaactttttcttctcccacaacactgcctgtaatgtgtctgtggttagcaaaactgagacagtatggcttcacagggagtaaagtgacgaaggaaaaaagtctacaagtaacttgaaaatatttacttgaagtattactaagcatttgccaaggaatcaaaaatgttaatgagaaagatgattctagagcaatgtgcttctattataacgacttatataaggtttcagttactttttcacttgtatatcaaagacaccaggtctcctaaattaaccaaaataagactttgaaaatccaagtcaaccctttaaaagctactacactgctgtggtggaaagaaaattggactggtgtctagacctaagccatccaatatggtagccactagccacatgtgggtattgaccacgtgaaatgtggctagtccaagttgagatgtgctgaaagtgtaaaatacactgaattttgaaggctcagaatgaaaaaagaaaagaaaatgtctcgataaacactcatattgattatatattttttatatttattatacatggaaatcataatttttgatatactgggtcaaatgaaatacattattaaaatcaatttcacctgtttctttttacttttgtagtgtggctactagaaaattttaaattgcatatgtggcttgcagaattatttctattgcacagtactggtctggacactaggattcttgtccatttcaatctcttgttggttgtgatgaccgtggtcttcttaacctcctgagcttcatcatttccaaatgagagggatgaaaatcaaggaaatggattctaaattttatagctccccaaattataaaattttatctagttacttttcacactttcattcctaaactccatgattcattttcatctgcgcccactctaaaagaagcagtgaagaacacccaataggaaaataggttttattcattagtcaattaatttaagaacctatagctccctctgatgacttttagactaaaatttttcaggatttgtgtaatatttttaatgtagacaaacttactaatcatgatgaataaaccaagatgacgtatcaaataaagaatatctatgccttaagtggatgtggattaacaaagcaatgaatcgagttgcttgttttgtgaattcaagctcactatcacaggtacacttgattgcaatccatttggtcagaaggttaccaaagcctcagagaaggtttttccactaaatccaagaaagtgtatctgaaattacaagatataatgtagctgatccctcttggaggcacaatttttgacagaaatagctgcacagattgcatcagttatacctaactttctgataattcacaaaacacctcttcacatggttcttaggtgggtggccaggccaggaggagggtatttttagaagcctgttgctcccacaactggcgctaactggcagtgttaggtaattacaaagggctaagggaaacgcatgtaaagaacaacaatttcaggtgacaatttaagtgcttaattatatactaaaaaaaccttattatttttatttctctactgttaaaaaacgatgaacaactttattctctgggtaccctaatattaataaacctttggttttataggttatactgaagatttgaatcagtttgctgtctgaatcaaagaaagaaaacataaaacaggaggagaagattaaatgcaagtcagaaattcagtatctgtttaatacatgtatttttaccaaaatgatggtgaaactaagccacacatcctggctcactgaaagcctttgttggaatacgttgttggacatgtaagacacacatgtatccttgctttatggacgtattccagtaaacgagacacaaagtagtcaggttagccaccagagattgaaagtgcggcatacaagactcaggacttaaaaactaggagagagagggcatattgtaccagactgaattatttcctgtcatgacgtgtttaaaattctaatacaaaggtagcagaaaagagagatcaataaatgacgttatattctatgtatccaaaaggaagaactttctaaagaaacgaaaagaccaaagtaaaaggcactaacaagtagatgcaagtgaaggagtagaacagtattgtcaaagctaaggagcctgcagagaaaaccatcagaatggcttaaacaactacactttgtaaagcaattcagtcgactatttaaaaatttcaagttaatatgatgtgtagctgattttaaggatctaacttacatgcaagaaaaacattagtttaaattatttgctttttaaatattcctaatgcataacagataaacactgaagtgaggctggattaattcatagttgctctaataccagatgtatgtgggtcataaagtaaatggatctttccaaaagcctttgggaaaaccccgtgaggccagttttgagatctatcagtagcaggaaaggtaaaaaggattcagtaaaaagcaaagcagaaggtaggaaataatgttaccttagaaactgatgtattgtgtatttttgtctccttgtttaatgtttcttaaaacagagaacatgatttgcttaaatgtcaaacttggaaatcatattgatctcaaaagatcacttcgttcaatattaagttttagcctagtcaagaatttcttaagatataccaaatgtattttaaaatattttaaagtgctacttcaaaactctaaactacaatgttttttaaaagccttatttcttcacagcaaggagcttccagaaaccactaaaacattcttgccctttgaatgtctgggcatggtctcttcatgtgttattaataagctagacgaagtatttatattaatggccatacaatgaatattcaactgcatgtggactcataccacagggctatgaaaaccgaaaaccaccttcacgtggacttgccaaactacccgattataccaaacttttcatggcttaaacaaagttatataaatgttcactatggcaacaacaccagatgtatgcacaaggaaatatctgcaattttaaagggggaaacaagaaaaactgctcacacaacataaaagttaattttacattagtatcattaatattatactcacactgtaacagccaaataaaccttgtgctttaaaaacagatcaggtcacttgagtcgtctgctgcattccgctaagaaagcaaaacctaccatgcatggcaagtgttgacactcttcctcaatgacttttattgtctctggtcaacctgtagatcttctttttccaagcatggaatcagaatacctcacttgtagaaagttacatcagtggtattaaaagcatattgaaaactttaaaaagttgatccaaatggaagtcatgtttttaaaaaaaatcaaagttatttctctagtttatcggagcatttaaggtttttttaatccaacaagtatttatttaaagaatgatctttatgtggctgaaatgagaatgcacacatgatagtttttcaaggccagcaagcacttcctaaccaaatcccccacttcctttgctagctaaacataactacttcaactgtgtacatcctttaaaaagttagaagagagcacctcgcatgtaatagcaggcagctgggaagccaattggtgcagtcggagtgcacattttagaaagcagctttttaacattcaataactaagtggtaattggacacagaaacataaactgtcaaactgaatcaaaacccctttgcttttcagagaattatttgtaagattatactagaattaaatttgaacatgcatctaccctatgcattagtcaaattatgaaacaaaaaaaatgctgtgctttctttggataaaattaatgtcagctttgcgtccttaaaccagacccgatcgggaaatgaaatatgtttagtcctgaaatagttgtggtaattcaatccctgcactctccttattttcttgatgacaaagaaaaactcccaactggcagggccacctgcactgattactcctccatccacacccacagaatatgaaaatgagccaatgatcattaaccttaatttcttctaacataaacctcagctctttttcagtcttgctactcagggaactcccctgagataaaggaaaagagaacgggggaaataaggaaacagggagtgaatgctcagagcaaaaggcggggggcggtccaagtgaaaagcggaatccactggcgttttaaaaactgcacagccggcttattaaacttcatacagaaaagaggttacaaagataaagagattctgaggcatcactaactctctagatagtgggatactttcctttctgagcaaacaatgagaaaggctgcttcctctccaccctccctatccccgaccctgggcatcgcactcctctacctagacatcactataaaaagacagccaacaataaagatgggtctggacagtaggaatgcatgtgtggcggtatgatctctagtatgaggaccaaaggacctctacaaccaaaagagatttccaaggtaagcacttgcaattacagtggagaatgtctagcaccttctggtcattcacattcaaatacagccaactggaatcatttttggtccaagctgtgtggagctagataccattagcattacatcatcttctaatggatgaggagctagttggggcccttaaaagaaacacaacttggaggggagcaggaaaccttcagaaatgccagtctctttagcacagacatgtgtactgaaaattgtcttgtaatgtttgcctacagaccttggtatatctaaagaggactcctcaaagataagaccacaaaagtgaggaacaattcaacaaggcaaccacacatgaccctgtgtaaagcattcctgaagctgaagggaaaacaaacttcaaaaatcatgacattgctgaatgaaagcagaaagtctttaaaatgcgagtttttcattaaaaatattaaatgcaaaggcgataaatgcttaaagaatataataaaagtcgaagtgttttttcctgcaagtacatttgcaagatgcatggtgcccacccagtgcaggcagacagagcaaaactttcatctctcagttatcccctcattatttcaaccacaaatcaagtagcagtcatgaggagggtgagacagaaaggcagagaaaataaacaacaacaaagacagagacctggttgcaatttagtattggattcagaagcccaatttaaactaaaacctggctctggggtgctggccctcatctccttcttgcctagcctacgaaacgtaaaaggcaaacacacacacacacacacacaccctgtattctcttttctttctcctttttttccttccgtaatcaggctctcaaatgtcaacggtcccctctggaaggaagcgagaacagggtattgaagtatgcagtgccatgagtcatcttactagatgctctagcaactgcctgtgacccagcagtgagccaagatagcagggcttttaataaagcagcacgtttgcacactcacagccctgttaatttaatacctgccgcttgtttaccaaacagcacgggcatgtctccgtgtcggtaacttcccagtgacagtgaggcgactgaatcagggcatggaacagatgcacctttttacgctctgttacactgtgtcacagactacagcccctgagcgcattcctttatttatcctgcagccagttgagctaattgtcagagacagacctggttctaattctgcagagtccagcaactgctggagtgtatgtagtgaggcatgaacggtgcagaactttagaagggaacagttgaaaaacagagtctgagggtagaggcataatctgccaatattttacttagactttgaaaataccacctgtctcaatagcaggctatgggagtggggacaaaagtaaaacaactccagtgtcagaatgaagcagaagcaagcaaatgtcaaagcatattcctatgtaaggagaacacaacacagcagcaatggcattcattttccaaagaatatggttcggcctgtgcagttgtaaaatattcacaagctcaaaaacctggtgataacaggccaatattcaatgcggctcacaccagcagttctgcacaataccaggattgagcattacagagatactgtgatgcaagcccattaatgacaccaaaattacttaaaagactagtctctcaatcctccagccatacaatttgagtctgcttgatcatgtgtagacaaagaaactcccatttattgttctcctcacaccctgtggtattagaagtgtttcttatgagctgtaataccatactcatattttatcagtagcaagagttcactccagttaaagttcttcacccgtcatgggcatttttcagcaaattaatgtcttttacttgcatgacttcccttcatattataatttggggtttaaacggatcataatactttgcagaaagtaaaaagagaaaaagagctcagtgttgataatttttaccacttatgactgaatgacctcaactgaggaataaaaaattaagtcatttgtcttatgaggtacaaaggacattttacggtgtacaatttagctaataacgggttcaggccaatccttaagaagtcacatgtttccattgtcccttcaccccctgcttgtgtttttaccacatcctaacaaaaacatgaccagaactggtgaaaaacatacggttccaactaatgaatcacatactttcccgcaagtacagtaagtactaccagctgtgtgacagtcttgctttggcagtgggaccagcttagaacaagccggctcatctgaaagcagctgtactgaaaaaccacaagcaatataagtgtgtctgccttctcagggcggctttgtctctgttctatgtctctgctctgtccccataatgtgccagccatcttgtttagagaaagtttcagaaattacagtggtagggagaaaatccacacattcaaaaaccttaagttttcagaaaatgttgtcactttatcaagtggaacgccgtgagaggtcaattaaaggaaaacacctctctcccacatccagccttccacatgcatcttttggggtttgccttagatgtaaaagtgtgcgtatttatgtatctaaataagtgaggtgggaaacagggggaggaacggcacaggatccagctacttacagatgggctgaggcatgcatgcgaacacacacaaacacacacgcagagcaattcgcagattatcaactcatgccatgagctactgcaaaaaagttctatgattttaaacttgccatttatacaacaataagcttcatttgtaaccacaaagcattctgaaaaagattccctggcaagccccagatatttttacacaaatgcacttttcctttctgtgaaacaacattcaactggataatcattgctgttaaagggaaagaaagtccaacagcattggtctagaaatttaagtggaaatagtaggatttttaaacttctgtagtgtctgaaggcaataagtaattaaaatttttttaatgtcattaagtgatcagtagcttgtatgtaagcacctaagtaccatctcaggcttgttctgcaaaaaagaaatacctaccgttgtcattcttgacttttccaaagtctcaatcagaaaaataaatacagagtagtgaaattatttttggtttttgtcagtgtttcacatacagagaagtcaaatgtaaggactaatcgggaaggtttaccttttatgtttacttttattgcctaatttagccaaacacattactctaaactataatgttgtaaagatgcttgattcggcaataatctaatccaaaaattatattaacatcacatctttttatttacaccatagttgtgtgaataattttcgttttgaatgagctatcaatgtaatactcaaaaaatggccagaagactcactacattcagaagattcactacattaattagagaagatcttggcctctgtggtttcttcctaaaattcactctttctaaatgaactttaatgtttgtgtgtttgggggagttcagtgctgggctgatcaagggcaagtacttagggtgaatctagaaatcacattgaggcttacaattggataaaggcagacagcagaactgggagcaccaacagtagtggggaaagagtaaaggatgagcatctgcaggcaaacatcggacgaactcaggttccactccaaaccaccacataaaccaagtcacatgatttttttttggtttcccagtgcatataaaatttgtttattcgatgctgtagtctattaagtgtgcaatagcattatgtctaaaaaaaacagcatacatacatctaaaatactttattgctaaaaaatgctaacaatcgtctgagccttcagtgaggtgtaatctttttgctggcagagggtcttgcctagatgttgatggctgctgattgatcagggtggtggttgatgaagacgggtggctgtggtgtctactcataaaatagacggtttgccgcatcaattgactcttccattcagaaaagatttctctgtagcattgatgctttggatagcatgttatccacactaggacttctttcaaaattggagtcaattctttcaaactctgccactgcttcaatttgtaaaagaaatgcagtatctgcagagtgcagtaaagccaagtgcaataaaaggaggtatgcctatgttcaagcctgaagaacagacttaactaatacatagacttgaaacagtacactgataaacagacatataattttaaaaaaatattgactcatttatagcacttagttcatgttaaatctaataaagaatactagtctaagtgggaaaagtccaaaactggattattaaattacacagtaaaatctatcaagaaagagctaatatggctgagccaaaattatgattaaattatgataaaagcattaaaactcagttattaataacatggaaagatagttacaaaatgttgataagcaaaaagcagcttacaaagcagtgtacgcaatatggtcctctatttttaaaatgaatacaaaagacaagtgaaaacaaaaaatgattaacacctgtgtggaaggaactattggcgatgcttttactcttcttaaattccattttctaaactttatttatttagcatgtataaactacacataggaaaaataagtgtacttcttttcctttttttaaacagtgtgagaaattttatttttaagaaatctagtaactagatttctggtcctcaccagtagttacactgcaaaacctgtgtattatttaaaaatgtggagcgtttctttttttgaaacagagtttcactcttgttgcccaggctggagggcaacggtgcgatctcggctcactgcaacctccgcctcccgggttcaagcgattctcctgcctcagcctctcgagtagctgggattacaggcatgcgccaccacgcccagctaattttgtatttttagtagagacggggtttctccacgttggtcaggctggtctcgaactcctgatctcaggtgatcagcccacctaggcttcccaaggtggtgagattataggcatgagccaccatgtccggcctggagcttttcttaaaatcaaaaattgatttactttgaacaattctttaaaactacatttatggggtacgtgtgtgttctctataaaatctcaagacaaataaccaaacttacttatcctctccccgatacccagtttcccaagagtattctttcataatttgagccaaaaactagcctttgctaattcaacttttacataattaatgaaccacagatctaaatccttatctttctaacaaaaataatacctttaaatagcacttaattgccaaaacactcccataaaataagaacccatacccccaccgaatcaccattacttaatcccaaagtctagaggctgccctgtagcgcacagtccagggcactggagtagtatataacaccatcacaggatcaatgcaacagagcgaatctgttaaatacgcttatccacattgaaacatggcagaaataactaggttaataaccatactcctataacaagggacttagaatcacagccaatagtcaagaagatttattattaaagaagcattcaaagtttttcattctgcaactgagagggctggtatgaacaatcatttggcaaatacttattaactgatttccgtggcctaccatcgtgtccaatgtttgggtttgaacaaatataaggaaaagcatcttgacataaaaaccatctagtgaaggagaaaattcaaataatttatcacgttgtgcagaagagcagaaacacacagagatttccagagaaacagaagaaggcaccaactcaggtagggctttagaacaacttcagaaaaaaagacagaacataatgaagcttaaatacaagtttagtagccaaccaggcaagataaggactagggagaacaacatgggagaatgttccacgataggaaatagcacaaaatcggcaaagaactaccagctgatctgtgttgctggggcaataaggctgaggcaagaaatgacaagaatggcagacagggtaaggggcaggtccaatcatgtagggtcttgtttgtcccttttaaggagattctaagtttcccttcacctaattcagcagtgagaatgctcagtctccttactccagaagagtcaggactacccatgtcatcttgcatatgatggtaggaactattccctccttttttttaatcgttatttttatttcaaacaagtatttactgaaccccttctatgttttaggcactgagatctcaggatcagacagtcttgctcctcctctgtccctccaggagttcactttccgtggatcccccacattcggtaataatttctttaaaagcacaaacaaaaaaactggcatagccttgtacatcttctggagtctgatggctaagaaagactaaaacgggaaaaaaaaaaaatctgtgtatgtaaaagcaccatattcccaaatcattttatcaggtcacattctgccaaactgatgaactcttaatttaagggaacaatttgtcaaggctctgctaattgcagatattagcatatcagaccaaccaaaacttagaaaacttattctcttgataaaataacagatgtggccattttatataagccataatgcagacagcatacacttaggtctagaacacatctttgctcacccattacactgagtacagactgccatgtctctgaatgagacacccatcccaaggtctaatttaacgccatctggtaatattccagatgcaagagtgtgatgcaaattttgatgagtcaaattttagcaccaacttttatgcaaaagtctataccctgtaaaaaccactttctcaataattcctaaagcaatactcttagggaaaacaatataatcgagttttataggagggtaggtttcttaataccagctggcaatatttgggccccgaagcatgagaactgatcatattaaaatccagataccagctattatatctaaaattgttgcttcattcatatttagcatgaagaggagcctatctaaagcaggctctatttaatacaatgtggttttaattggagtctgttttagatgagccacctgtatttcatctttttaaaattatccataattttctgcgcaatttgcctctgcaacataacgaagagcagttagttataaattattgccattgtttagacgtctaagaagagaaaaaactctctatttactgaaatacgatggccctgtaccaaagaacaaaatggggagcccaaggttctagttctgtcccagtgcacaaatgaacaaggccatacataaatgttattaataagccttaactagaaaaacaacagattaaaaccctgttagtcttactccagctaaacttcatttatggctactctgaagcctactgttacaataactaaagtctcacattcttttctacttaaaagagcctctttttaagcatttctaaccgtgaaaattctgcttccagcaactacctcaaataactttttttggtagtgcggtagctctactttgcaattatgtctataccaatatattcttggtttgttttcaactaaaaccattcaaaagtttttataatatcattatttcttcaatattttccatcttcatcgtgtttatctaataattgttaaggtatccggaaatacagtatatcgtaacatcgtgacaatgtttcctattcagatccaagtaaatagcggtttgcaaactaaggtatgtttatttctgtgatggctacaagaaccacccaaagaaaacatctaaaatgcaacttttaaagaagattcttcaatcaatctgttctgaattaccaaaaacataccccaacaggtaagtcagaatttcagtgggtgccaaatatattataattatttttgataacatgctaaaataatgcttactctaggctatttagcaaaagataaaactgtcacaatccatgtaaatgtgctgacactgtttattaaactaccctatccaagcgtttctcttgatgcttaccagctaatacaagtgattcctaactagtacttctctaaacaaactgttccacaagactctactcatcccgtgttctgacaggactatttatatgaataatattccccaattgcaatttgtccactgtgcaaattcaatggacttaggtatgctatagaaacagcatctttctctttgcaaatgtcaatgtatttttttccttcaatatactgtatctattcctctattattaagttctgagcttgctttaccttgtccgctatttaaaacattctgatttgaaagtatcaccaacagcttatgtgattttccaaatttctcaaaatacagttgtcaccattagtcacatgaagtctggatactgtctggtgacaaataggtaaaccaaatatgattattgttattaagagtaacctcttagtcaccaaatttatcctataattagaccttcaaatatctttttttttttttttttgagacagagtctcattctgtcacccaggctggagtgcagtggcgcaatctctgctcactgcaagctctgcctcccggattcacaccattctagtgcctcagccttccgagtagctggggctacaggcacctgccaccacacctggctaattttttgtatttttagtagagatggggtttcattgtgttagccaggatggtctcgatctcctgaccttgtgatctacccgcctcagcctcccaaaatgctgggattacaggcgtgaacaaccgcgcccggcccaaatacctcattcttaaaccccaaagtctgagcccaagaagcagtgtacactgaggggagggggaacacatactaataaaggtgtttttttttttcttttaatccaacccaataacaccagcaatttccttacatattccattatggacattgtagcttgaattcagtgccacttgacagaatctattagtaatgtggtctgtataaattacataccgtatactccatatggaaacctattttcaaaataacctatgcttaataacaaacataacttggggtatcttttgcagtttctcttgcagtcttagctgcattatttcagcaatttgtctgttcaggtatttagtctatgaagccaaggcttttaaattttctcactgtagttaaaaagagattaactttaatcccatgtcatattagttacaagataactagactctttaaaagcaccatcagaaattatcttgattcagaaattactctgaacactagtaggttaacagtgctcctgcataaacatacttgtttgtggaaattactgattttgtttatttactttataattttatgtatttttttcttggtctctgtcagataaaatttgttagtcaatgtgccacaaactctaactttatttaatattttataatacttttgaataccttgataacagcaagtattttttcattttaataaatgtggtctggtgtttatgtcaaaaatttacaagaaaaagctattttactggaaagtaacaaaaaataattgtgattaggacagagctcaaattaatactgcagatttttgtgtgtatgcaaaagatataattagaagtcatatttcaaaattggacagacaattctattatacagatttcttggccaacttttgttggcaactcaaacaagctaaataaatttctagatacgatctataataaactcaacagataagctacagaaatgtttaagatttggtgcctagaggccataatcagtttttaaaagtaaaggtttcttcaacacagagaaggcaaatttgcttatttaaaacctaacaaacaatacatcccacactccatatggcaaagggtaggatggtggtgagggcaggggacaaaagagttcccaaaaagtaagggaatgtgtagaacaggggatacattaagagggttggtttgtttgttttattaatattcagaaactggaaacaatttaaacttaagattgaaaaagactcaaaatctgcacaaagcatatggcaaaataatcttaggaatgttccttggactactccagaattttagaatatggagactgttaagatgagtgaaccagcagacactcaaaggctaaaatgtgaaattacattcgcatgttggtcatataatcataatgctgaaaaattatctacagaaaaaaaaatctgctaacataaaaataagaaggtctgaccatccatagttcatggttctagaagatgcaagtttttaggtgaagactttcttttttttttggagacagggtcttgctctgtcacccaaactggagtgcagtggcacaatcacagctcactgcagcttcaaactcctggactcaagcgatcctctcacctcagcctcccaagtagctgggactataagagcaggcaaccacacccagctaattttttaattttttgtagagataaggtctcactatgttgcctagggtggtcttgaactcctgagctcatgcgatcctcctacctcggcctcccaaagtgctaggattacaggtgtgagccgccacacccagctagataagctttttgtataatgcctacatatctatatgccatgaagcatggatgaaagaagaatccagtaacagattccaaatctaaagaacaacaagaaaatacctgaagggaagtggagaacttccaggttattctatcttttatttcttccttttttagccaagctactggaattctacatctcaccagatcctcaaacaaggcaaacaggtgggatgttatttgaaactacagcatttatttaaccaataaactagaagagtgttcatgcaaaatctagattcaatttaaatcatttgtcctatattattccatgatttaaatatatatatatatgtattttttttttaaagctcacatagtgctttcctagctaatgggaaaaacaagctagaagacccttaagagtaaaccctgctgtggttcaaagacaactgctcttaattttttttttcttcttcttgccatatagaaagaggcaatttttttttctctatcttcttatcttcttttcctaccatacccttatggcttttattagccacatcaaagggtatagaattaattttgtgttcaaaattactcaataacaatccccatatatgagctcttacaggaaatcacataaagaaataagactcttaaagtgcctaactgacaagcaaaatttaaaagcaaactgccccctttactgttcatgtattcagaactaaagtgaagttggaattatgtgagagatgcagtgagagattcagcaagcattcttacagtgtaaacacagcagttcaagttgtgatgttcacccaacatcaaagccatctatccagaacatgcaggggcaagcctccgccagggaagacctgtctgtgtcaagtagattgctctaactccccaaaataaccagtgtgtgatttaaatcacaacagtatataataaactctggctttatcatgctaattccaagtgttcaaagccattactaaatttctgaggctggccaaaatatttatttaaaaaaaagcaaaaacagtaacttttctaaaaggcagcagcctcatgtatttcaaagatgtgtacacacaaccatgcatctaacacacctgtagggcaaagcaggcctcacctgggtgaggagagtgccccagctactagaaattttaagatacaaatgaaactagattaaaagaaaaaaagccatctgtctcatcaaggttgaacaagatatatcaggcaaagaaaaaaaaatgcatagattcaaaatgcgaacagtattgtggtgtaatatacatacagtgaaataaacagattttaagtgcccagcaagaatatattttggagggaacatgcaaaaaatcagaaatatacttaggtgtggctgataacaaaatcactgggacatcataggcaactataattagcaatggatgactccgagcaggattggatccgcctcctaaattttaaatgattgcttcaagctaaatttctgggaacttctttggtctggtaatcagtctgggagtcttgtaggaacaagctttctcgtgatatttccactgcctcgtggtttctggcaaggttgagccgtctacagaaacaagattttctaacagtgttttgttatttccatttcctatctcatctgaaaccaagtgcatagacataaaaatgttgaaaatacatacataagcaaacttttcatcaacaaagttgtttctaaatcaactcaaatgaaattcatcaatagtactttgaagaatcaaggcagatcattactgattactggataaaacagaaaacttggataaaaataattttatattttttaatattctcctaactgtccagcattaagaaagtttaataattaagacattttagtaagttaaacacccaaaaaaagtcttaagattacaaggatttttcctacacatgattcttcaggctcaggttctcccctgtacccctcaaatggcctgtatggctctaattacctgtaaaacccttacatataggttatgttatcatgcattatgtgacattccactcataaaactatagtcctagagatagacaacctttaaaagaaaaaaaaaccttcatctacgaaaatacactaaacagaaaatggcaaactacaaatagagtacgataatactatttttaatgtttccttctctccatttattttaaatgagtaaaattgagtctctttctaaacgcacataaattgcctcacttaaaaccactggataggatttatgattctcagtagggaatgtaacatctaaacacaatgataatataaattgcaaaagttaaagataataattagaaagtaataatgtctagcatagcaatgtaatgtaagaataatgattcaattattattgatttgaaaatacattctaaaagtccaaggtttaagaaactctcataagaagaaaaaggatgtcatgtgtaataggctattttccctcaaaagaaacttttccttaatgtgaacttaataagtttgaggttatcaaaaaaattactgtacttattttttaaaaacagaagttaataaagtattcttggatgacactttaggagacattttatcaaaaccaaattttagttcaataacagaaataatgaaaatttatattcataacaatgttgttattggtctctgttaagcaatggaaaaaatctggtcattttattctaatattaaattttagcatttgcttactaattaccaacatctagaaagaagaaaagctcagtgtctggcatgtttgtttctgtagacataggtctaacatatgtatttcaaaaatgatttcaagttttaagaaataattgcaatctcaatacaccactgttgaatgctaccactatattcttttctattatctttatgttagtgcctcttcgttaattctcatatcaaatttttttatgtccttattaacaacaataacaacaaaaccaaatgaaccttacaacaacacatgtgaaaacacaggaaaaaaaaaaatctcaagtcaggcacactggctcatgcctgtaatcccagtgctttgagaggctgaggcaggaagaccgcttgagcccaagagtttcagaccagcctcggcaacacagcaagacctccatctctacaaaaattttttttaatacttagccaggtgtggtgatgcatgcctaccatcctagctacttggaaggctgaagcaggaggactgcgtaagcccaggagttcaaggcttcagtgagctatgatcgcaccactacattctagcctgggcaacagagtgagaccctgtctcattaaaaaaaaaaatctccaaagtggattacattttttcccccattagtgacagacagcttgagggattttttaagagtgattttgatttttacagatctatgaacccatttctattatagctcttctaaagattataaataaaacgtagtaatacaaatctcttcttcacaaaaaaaaaaatagagactagcaaagaatttgatacacctctgtccttaattttgccaagtcacatttcaggttaagaaaattaagcaaaagaagaaaacaaagtcctcagactacaaaagccaagagtaataaaataagtgcattggtgattaaatccagaaaccaaatattcagagagggtctcaatctctctctctttctctctaagctacaaccatcattcctatcacatttcatatccagatcatctaaacagattatattaaatacaaatacatgagagttcagctaattttgacacttttacaatgtttaacaaaacacatgagggataaaatcctttcatgttagaaaatggcaattattaactactagttttcaactaaattttcatttactggttaatagtttccaaagaaagcagagagtcctcctgttcttattgcacttcaacatttcaaattatacaactcaattaagcggtcattctattaggctgagaaaacatgtagaacatattcaagtttatgcaagaaactgtgagggatggtttgccgtatacattaagcatgaccttaggcatgtattttaagagtgtttgataaccctatacacccttcagaaataccccaacaggaggcatcaaatttgtaaacttcagcttgcagcataacagactagctagggaagagtccaaactgggcatcagaacagctgcaaccaagacctggctctgccccttgtggtcacaggacatccaggttctggatttcagttcttacagtgaaactaacactaggatcctgttactttagaaagagaggtgtctaagaactcaagaagcagtacgttcacagctctagaaagagttaagacaccatcactgtgagcatttacagatgtgccaggatgtgaatataggaaattggaccctcagaacaagaccttagaaatgctcacagagaaatgcatgagaattactggataaagtaactactggaaaatacaaagaatgaaggctttgttctatgttgtagaaatcattaccagaaaagttcattctcaaagaaagaccactgattacttttttaaatccctgcacaaaagtaatcacactatgtacagtatgcacagtatgataatttttcaaaatacttcagattgtaaatcattgaaaaagtcagtgagaagattaaaataaaatcatggaaaagatcttaaattataacagaaaggaagtggtcagatgagtgggacatttcttctctccttcaagaaccttccctttcccatgtctgggaaacacaaaaatctacaccaaataaatttgctgaggcactttctcagatattttaaagtgagctattattaatattacaaataggtttactatcccaatctgttgcctctatttaattaatttcctgattgtttagtctaatttgctagactgtttcaaaagataacttaatttcaccactaaaaatttctagattaataaagtattcggatgcaaattacatattggactaaacaatcctgctatcacataagtgtctgaaatcagtggttccagctaagattccaaaacttctagtccaaataaatgttacatttcaatgggggcatatggattaaatgaaataaagcatatatacaaagatatggccatgttaaatatgtatcaaatatgtaatcaaatatgtaaactctctttctctctaagctacagccatcattcccacatgagaattccctttttttggaagatgccaagaaataatcaaaataccatgtaagatgatgctatttaatggaatggccatttttctgtttgctgttaacatttaattaaaagtcacaggcaaatatctactaacgtactggttaaagatttttccttcgcaattcagtaaacacccaatgcagcaagttattaagcaacatttatcatctgatttaccatcatgttctataagccaaaataagtagtgacccttcttctaaaacactcacctgatactagaaaattaccttgccaacatgctccttccacttcgttatccttgaaattacacctaatataatacaagttttgttgtttacttttatactttaaagtgagcacataaggatttttttaaggaaaaggagaaagaaaacagtatctgtaaacattaacaagtctcaatagcgttctgttttataaattctattttaggcaatactgcaacagcttttcattctgacctaagaaacatctccaaagttctttcaggtggcactagcattgctactcaccctggactcttctttgaaaggtagagtacatattttaacatattcttccttactatatagctttccttattttctccacactgagaaaacaacacaaaccatactacaaaaccactgaccaaaccacccttcccacagcatgtgcctcactaaaatttttctttcacttctgaggacacaaaatctttgaagcaaatctacaactagtggccaagcgtccatttggcagtaggaagactgtcatcactaatatcccatgctgtcttaagattcaagaatcaaggaagaaaaacagtgagtgccttggggccacattttttgttttcttaattttggctttcaaaatacagtctacagtccctatggcttaaatagtctacacaaaactttgttttggaatgaaaagcaataatcaaatccttctaggagaaggtacagttaagtagttcaagagtcacagttctggaatctaactatcagggttccaattccagcacctccacttactcttgctctaaaaatgtagacaagttactttctctttgggcctgtttcctcatttgtgaaacgagaatatgagtatacttaattaagaaagtaaccctgtaaaactgctgtcatggtgccaggccaacagtaagtgctccctaaactgagctatgattatcacagtagaaagaaaactacacagatgaataatgatcacagacctgtcttttctatatagagctggcattaatttgggattaaaacgtatgaggttagccgggcatggtggtgcgtacctataatcccagctactcgggaggctgaggcaggagaatcgcttgaacctgggaagtggaggttgcagtgagccaagatcacgacaatgcactccagcctgggtgaaagagcaagactctgtctcaaaaaaaaaaaaaaaaatgaggtaccaaattctgggagaccagaatttgggtctcaaataattagttatctactcacagaataattttactttctgtaagtctcagcaaccccaaacataagtaagaaaggctggtctggaatccacattcctggttttcaaccttggctatacatttgaatcacctacggaaagtgaaaaaaatatccacgcatagccccctccagcaaagattcaacttttacactggttatggtgtagcatcttaggagctgcaccatatatgatcttaggtccctcttatttttaattctagaattctttgctttttttgcatgaaaaaatatggagaaattatattctaagcatgtgaaaagcagcaatcacatctgatgtttcttggtacttataagggtagctgctattcaaaaatcatttttagcttcttctggagtaaatgggacaaatacatggctctttttctgccccaaactgaccttcctcagcatggtttaagattaaagattttatattaaagaaatcttcaaacagctgtcttcagcacaattttcctcaagaacaataggaacaagtagccagttttaaaaatcttgagttctcttaacaccataaactttcagaagaacctatgggaggtgtggaatggggtagggctacacctatacgcctgtaataagtaccccaagagaaccttagaagagctttctgataacctttcaggaagtcaaagcagagattcacagatttacaaatggtaacctacatcaaaagactttgaaatatcttttatttctattctgcctttctacaatgatatcaaagtttcctatacataccaaatcaaaagatattccagagagatattttcattctcaatttatcaatggagtcaaggggcaagaagaggaaaagaatctagatatctagaataaccttaggtggccccctcaagttattgcaagatgaacagagaaatgacaaggttgaatcaagtgatcccttaggttccaagcaccttaaatatgttttgattaaaatttttaaacaagattctctcttggatggtattgagcattgaaaataaacttcacaggcaacaaaacttaaaattaaagctggtactatctaatcatgatgactattaatagaaaaaaataaatcaactcggtgcattctagatatgctaagtcatttatagtcatagggattctgaataatcccaaattctctaaaatgttcatctttttctttaagcttatgtattgtgtttatagaaaatcaccatttatcctttaaactagtcataacaaagatgaaaggaaagatgtaatcagtggcataagacagttaacacagtgtcagtctaagagcatcaagagagaaacagaaagacagtaaataagtagcacatatcaaacattgcacagccagcccagcaactgtcaaggaggggatgagcttcccaatggagagtagctgctgccttgtgcaggtttcttttctctttctctttcttttcttttggctagtgctgatttaggtacttactttgctttttctctttcaattcaaagtttgaaagaaactagaaactgttccaaagtacacttcgtaaagcagcccctaactcttcaactttctctgcttcacaaagtcgtcagcattgtaaatctaagccataatgaagacgctacatttacatactttaaagaaatcattcctgactgctgtcataatagtctcttaggtaaactcttaacacatacaagaatttctctagtccttgtctatgacttgcaggtaaaaaagataacaattaataatgttccttgaaccttggcttggataagagaaaaagaagatttgaaagagtagaggaagaggcacagggagacagtctaggtttcttctaactctatattgctgtggaaaagttaaagaatcttgtctcaaaatcttcaccttcaaaatgtgcacaacagttcttactactattctttataaaaaattattattttctgccttttcacatgttctaagacccttaaatgaaaagaattcaatgcagttagaggctccagttcacgtcacatttttatacttttcataatattcaatagcttaacaattatattacactggatattttatacccaatactaaacacatgtacattaccacactgtctattttatacttgggaggagatgtccagaaagtatttgtgggacttagaatagaatgttggtgggactggatgtcagatctggaatcacatccttgtcccatcacagcacaagagttgtataaccatgggtaagttatttaggcttagtttcctcagctagcaagtgggaataataacagtattaacataaacaggatgttagattatatataaattaatgtacataaattcttagcatattgcttataatggttaaatagtttaataaagaataagtattattaacctaatcacccagcacttctgtcctaaaggtatctagagaccagcaggattacaagatcctctcaagtagcaactcaggtccagaaccattctgggacttctgaggcctttaaaacctacagagaaaaacactgagggcaggatacattatcgaaaatacacatcaggagacgctcaaagacaaagttcctttcaggtcattccacagggttctgaaaaggccttcgtattgtttcagaatcctcacttgtacacagcaacacgtctaccttccagttagcaaaacagtttcacaacgtaagtgaggatagcaaaagttttaagatgttctaaaccatctcagtgaactggaggtcaccattccttctgaagttcaggatgtgaaccaagaatacccagaagcctgagaatttgggatgggcattcagcccacagctggggaattccagcacccttgggcagggaagtagtaaaaaagtgaaagtctgatgacagtcaactatttgttaaactcaagagttgctgcaattttaagatgtctccactatatagaaacaactcataaaatatgtctaaatattcattttttaaatggctgttgtttacagtgaaatactacttggtaataaagaagacacaaactactaatacacacaacaatatgagaaaaacaaacaaaaaaagccagacacaacatagtacatactgtatgatccaatttatataaagttcttgaacaggtaaaatgaatctattgtgacaaatcaaaataatggttgccttaggggaaaggagattaactggaaaaggcataagggaacattatggggtaaagaaaatgatacgtactttggttggggcgatagtttaatatgagtatacacattttgtcacaactcataaactgtacacttaaaatgggtctatttcattctgtgtaaattgtacccacatttaagaaattcggggttaaattaaaaaaatcctaaatttctaaaagggatgcaaaaatagaagaaaaggtcacaaagggtatgagatattgtaacagctgggaatccatagagggtctactgggatgtcatccatagctgagtcccccgcataagttacataaggttccccatatgaagtatcacagacagatctgtttcatttgtcagtttagtagaccatgcccacccatgagcagacatgagagagcaagttaaaagtattacatgtgggggaaaggggtgtcggaagacaaagaggagaatgatggttgattttatttaaatgcaacctggttgtagatgatatttcccatgtacactcatattcctcaagcaaacatctacatatggttgtgttttcctgatgtctatcagcccttctttgttgagatttgggcacagcacatgttccaattaactccactctttgttgcaacttgctgactcgggtgtcccttgccaaaaaggggtaggtggtaggttacataacaaggattggggtggaatcttatgtcaagtctgcacagagaattggcggaatgtgtgtggtacgggtgggggccggtagaaggtagaaagaaaaagggagaccacaggaagaataacatccttagacagactttgacagaggccgacctggttagctatgtggctcagggaaaggaggtcaaagggtagccaaatggaagataatgaatggtcaatgcatagaatgcagagagagtttttctattacacaatcatttttcccctagggtgacgcttctgggaaaagtgtaagatgacaatgactttatgaagaagcttgatccaagtgcaaccatgatgagatttttgagaatgagggagagagagggtttatcaggttaaaggataaagtagccttcaacagaatttttcaagtaaaatataagagattcatcaatatgtgtattcccatcaatttagtaagtacaatactgctcactagaaaataaatattaaatatgatcctcttaggcaggtttaataaaggtatcttatacatttagatcaatatgctattccagttcacttgtggattagctagtctattccactgccatgaactatatttctaatcttattcaaccatctcccaattttgaaaaattttatacattaacaaaaatgaattcccaccaccagaaaaaattaagtgacagaaactaaatactaaaaggcaatcactgtaaagtatctctgagactggtccctttgaagacaaaattacagagagtcaccaatgtacgcaataaaatatgtgtgtgtgtgtgtttaaaaaaagacatatgaagtttctcagcactaagcaacaaacatgggcaaacataaaaattattcactagagagataaatgctctgctgctaatgtgaagatttcctagatgaggcagatgctatgaaaaacgaaaactgctccactactggaattatcatcacagttactactgccatacacttggctgtttttaactaaaactatatggttcagagattctttgggtttctatttaagacagtagaacatcaggacaccaagctctgaggagaaatgacagagggctaaataaggactgcatggtgatagcagtgattgagaacacatccaggttctattagccaagtcaagagagatgtgtgtaatgctggaaagcagcttaaaaacacaattctgaacatggaattcctttggcttcctcgaagactaaggacctgggagaggtgtcacaagacaaacactattcactgtgccgaatgcaaagtaatgaggacagaacttatcatgacatgtttaataacataattttgctaaggcgaactaaggggtggttaatgaggctccatcaaataagttatggaaattgtgtcacctgcaaaccacaaactatcacattagttaagagaaacatttgacaagcagtttccagtctcttgaccaattccacattagacaatcttgcaaatgacataattaacacagcttacttaactcatctccatttgcaattcattaggaatagttttttagcagaattatgccctctaaaggtgaccatgcacataagggcagtgaacaagtatgaggtactcaaactatgataaaaatatagtttgagtcaatcactttgagttaaaaccaatgatatctttatgtgctaaaatagcataacgacttagtcgccttagactctgtatgaaagacaaaaacatagaagaagtgtatctttgatatgtaagtgtgtgaatgcatatatcatcccatgctttgtacactactgggatatcaaatgatttctacaaaaatctgtgcgcacatcaagtgaaagagaatgagcctgactaacacagaatttccaaaggtcttccaggacggactcacgggccccagcacacccactgcatcttggagttgcaaagcagtgtgtgctatccacctgaaccacccagtgttttgagaggccagtggtctgcagctgaccaattctttaagaaccattagttttgaacaagactttcccagagtccttgagaagagaagacctggaagactgctttctcagacccttataaatcacaagggagaatcaagtccactggcgacagatctttctttccataagcctaatgcttttcttatgaactatcactaaactcagaggaaaagtaggagcactggtgcacaagagcttacaattagagacagaaaagggaagtatgggagagggaaaagcatattctgtcttcctttgttttgtgttgtttagggattaaaaaaccatcagtgactacaagcttgaaaagccacttctacaggcctctgtttcttttaatcttaaaatcttattttatgttcaagtggcacaatctataagagaaaggcatctatttctgatgtataaattatgaattagccaaaattttgttccagatgatacgtcaataaacttcatttgtttgagaggccaatgctatagaatcataaataatatagcacaaactttggctcagcctatactaacatgccaagatcattcgctcagtagtaaacttcagaggtaccccaaagaacagagctatggagacacagaggccttcataaatcttctgtaatcttgcattttcaaagtgtgggctaggggaacattaaattctcacccacagtttccaaaatggagacaccgaagaggttcatccaatctgataagcttagacctgcagtcagcactcaaccctgggtgcatggcagaggaaggcaaagaccaagaaagcaaaaatggagataaatgcacagttggtttcaaaaggactctgccctgaatacggaatattaaaggcataatgtcattcacaagacacaggaactctttaaaattcaaaacaatattgactgtctgcaggtattcttaaacggaattttacttgtcgaccatttttaataaggaacagagggcataaataggaccattccatttaaattagatgtatttttaaattgaaagtgcattgtgtctcagtgtaggcaggactgagctcaactggttagggcatcactgatgtgttcatgccttagtggtaaaatattctgtttttacctattctttaaagaaaattaaagccttttcagttcttcattcttccctgtacactcaaggtaattcccgtctgacatatgaataacagagtccaccaaactgcctggctgttttcacagtagaaaagattatttcaaaatttttttttattttttttacacagtagactaattactcactgatttgtgtttataaataatggcatttcagaccaaagtctgacttctataaatatgtaatacagctttaactggattatatataggtaaatgtagtattatgcagtatagcataatcaattgcattcagaaaagggaaatatcttatagaagcttctagctcaaaatatattgcagcttccaggtagcaaaaaaattattcacaaagctatgccttttccaatcctaagtgtcgcctactttccaaacttttagaaaattataggtccacaaagttatgtttgtgtaagttttgtaaatattgacatgtgctatacgtaatgcaaaatatttttcacttctaaaaattaattttatcttgcttttctttctagtcagataactctttaaaaacaaccatttctatatgcctcggtttcctcaccagaaaggatagtaactgtttaccctaagatgccacccactcatcctattccacagggatattttaaggattaatgaaaaaataaaggtaaagtgttgtaagctatgcaaaaaagaaggcttgaatacagaaacaatggtcatcttaagctatactttcaaaagagaccgttacgatgttgtaactatatctacctgttccttttccaagctatcaggtagatattacatcatgtatatttcaaaatgagaatctgtttattcaattgatgacttcaatcagtaaaagaaaaacaagtaacttaaaaagcctatcatcttaaccttagatttcagctataagcaaaatcagacccactttacatttccctttattactctgacagattctaaatgcatctttactttactattacttcaaatgattcatattacaagattttgtcacagaactggggaaaacaatacagggtttgggtttcttaccctccaccagtcacttgtcctagaagctaaacaaaactcccagctctggctgatcatggctgggagctcattaggctgttcctcacgttaaattactgaaaagggtgatgtatttataatacagcttgcgatgctataaaatggctcatcaatctgttttattcatggaaagtccacataaggccactagtctgttactggcaataaaccttgggtgcgtcttcaaaagacctgcatatgagatagtgatttatgtctctgtccaagaaatcaaacatgatactaacaaggcaagggataactcaactgacactttcaaaagcaatataatttcagtagtaaatcaagtgactataacatatacggagaagagagaaagacgattagcatgtatatattaaaataaaaaatagagtgttaagaaataccaatcctgagtgttcagatcttaaaccattcctaatctattctatgcattatttttcttagatggtatttcttacacagcatatgtgttcctcagctcccattttataagtggaatatccttttgtaaagacattgatatatcctaaatagtttgcttattttgttaatacccaaaggcagacttgttcagctgtttctaacctcaaaatgtaaatctgttttggatgagacataaagacccaacaaagagaaacaagaaatatttagaatcaacataagaaaccaaaataattaattgagtcattgttttcagataatagcacttttattagaattttttttctctcaggagtctgcaaaactcaatactacacagagatctcatactataaaaacaagtaaaaactaactataaaacaaatgtttttttttaaccattgggttttcttttaggttgccaaaccagtcacttaaacaaataggatgaatgtgaaaatggagatgtagaaaataatggggcttttcacgaaagtgaatgccttacttgttatttttatcttcagtggtctactttttgaaaaattcactttaataaaagatttaaagtgaattatacaaatgtaatatagtattacacacattgaacctgtctgcattattttacttgaaaaagagaaacctcgtttttaaaggagaggtttttacaccctaagtgcacatgatatcatcacttttcttccccatcagtgtgcctcatattttccttcgggcaaatctgaaatctactggagtttttcctcatggacagctcaatcttatggacagaagttgtgcatgcaacaacattcctaaaagtgaaagggagaaaggcatcctccctgttattgttagtcaaaataaaacactcagcttcagcaaagagtaactgaaacaccttctacttggaggcaagcatttctggcaaaccgaagtcttgacacaccaagcccaacaggagatagggtatacttcctcaagggcaccctgtgggccctactccctaatggtttacgggatcaagttttgaactcttgatttcaaaatgttggcggttatatgtttctatttatattagatgatctccaaattacaaactagtatttttagtttaaaattacctgattttcagaataaatgaattttttaaatgctgcaaaatgacttaagagtacagtgaattttaagactataaagagacctgcagattcatatggacaaatgggtctgtgtagttttactgttaaacaacttttaaaataactgcagatcaattaagtgtgacagttgattactcttccccatctcaccaaagcttttgaaatagagaagaggggaaacacacgcactcacaaatgtaagtgcccacacacagaaatctccccttcgatatgtacaaacagaaaataaactatctcctcttgccgccttaaatacaaaatgcacacatatacaccattgcccagacatccttcagtttatctcacggacaaatgaaataaaaagggcttctttttgtgtgttttaagacacacacaaaaaagcacacacgctccctccaagaatcctgcctccaattttctgtcacaaggagcactctgggggcctggcgggggaagtgtttgggaaacagaaggagccgtttcagcaggcatcggtttctctctgtgcctgtgaagtggacattggcatatcttgcctaggctgctcctgtggggttcatctggtcggcagggtggggaatagttgtctgcaccataccaaggtcagcctgctaggtctgacagtctctgtctctgtacaaagaaaagaatcaatacttttggactacggctgtgccctcagtgtaaaacaacaaacatgcagcgtctgacatgtttctaggtgatttgtggcagaacctcttgtctgatctgtatccaggagctgctgtgttactgctctttgcttttcgcctcccccactccttcctcggcccccctcctgcctgccccagctctgtgatgtctaatactttactcaggtacagaggcgggtgttctaccctacagctacttgtcactcaataaatcacacctacaagcgcagtctgcacagagtgatctgggctttaacaaaggatcagagggacaaagtgcaggcaagatgctgtaattatagcaaaaataaaacattcagagagagggacaaaagcacaggctcttaggcaactacagtagaaattgtattttttgtcctctcttttggtttcactctcttaatgcactcctcccatctttcctctgccgaaccccaacaccatttatttttgttgttcttgctcattttcattctaactagagttcagggcataacataagcattattaaagagtccattaaaataaacaatgctcatctcagatgttaaaatgtacgtaagttgtgctaatgaaagagaggcacttttaataattacctttactatcttcagtttatatccttatctaaaatatttgcgcatgcaggtcccaaatcctcctgaaacagaccaaaacataacaacagtaccaaaagacagctattaattatgacttgaacttaattatttgaacagccattaaacaatttaacttacacaaaaacacacttgttttgtctgagttaatttgtgtagatatacttcttcagtaaaatattaacatataggttgctcaatttgctttggaacaattttatactagatctgttcttttttacccatcccccatgcccccaaatttattttccagagcctgaaccattagccaagtcagataagaaggttttggacagtgtattctgttctaaatattttaaatgcagcagtttgagttatcccagcaatttcagtcacatcagacacctcttaatgcaggaaaaatgacgttccatcatggaggtcttgcacaagtctctactgtaactgttgctgatgaaaataaaagtgagttagaatagctctacacttccttcctagtcaatcaatgcctgacagcaccagttccttcagccatgtacttcagaaatgatagatcaataactgtggtttaacaacagggagccaccaatcattatacgaatgattaaaaggggtctcactcacatacacctctgcagacagactaggccacgagatcagaatccttgccacattatgcttcatattacagaaattcaagtaaaggaggaaaaaactgggggagggaaaatcattacgatacagcataaaggaaatattaaatgcttcatgaccatgctaattttaagccactatcttaaaacacaaattctccaaattcactaaaataaagatgaataaaagcaaatatggggggacagtgcttattgctaaatcctacaaagcatcaatgtattaagattacttggaatttgcccctatacacacctgcaggccgcatctgccgacagtatgagactcaggtaactatcttggaaatctcccctgcagtgacttattttatctcactgtattacagttcctccttgactatctatctgaaaagtctaaaaggccataaaaaggcaggactatttcatccaggaataaaaaaagtccctagcacaaaacaaaattcaagcattactgacaaattaattaaatgaatgaatcagacttttaaaaaatcgagtctctttttgaaataattctaacaaaagatattatacaacttccctcacgtgcctattatagaatattttccttgaattcacttattacaaagcaaagccttttatcaaactaccaaactgttccaaatggcaaaattctccacaattgctgactttcctttctcatttgtctagagcagcagcgaacgactgtcctggcatgcacagtcaggcagcaaagaacacgtgctgactgggggccactctgatctcagtactgttctagaagccacagatgtactgacctctgacagaatgaagatggacacgtgtggacatattcgccacgcattgtaagtacttcagaagaggcacatacaaggcagtgttcttaataggggaggtttgtcacccaggaaacactgggaatgtctggagacacttttggttgtcacaactgagtgtggaggacagttactggtagctatgagtagaggtcaagaagctgctgaatatcccacagtgtagcacaaagaattatccaacacaaaatgttaccagttccaaggctgagtaaccctgtgtgtaggtgctcagggaacacagaagagaatgtgcttaattctacctcgagaatggaggaaagggagaactctactcacccgtaaaagcaggagacaagaaaagtggttacaagaaaggacaaagggacgacaatggggccacccatgctgaggagtttctgtctcattcgatgcaccaggagaactgatggtaggattcgggggtggggagagacagaattcacagtaccagtaggagaaacagcctcaagaatgttgaaagtggagtctgaagtcaagaaataatggaaggctccctcacctcaagatttgctgaggtataactggtatacaaaaaaccacacaaaattaatgtctacaatttggtgagtttggatatatgtatgcattcatgctaccatcaccacaaccagaataataaacatattcatcatctccaaaagcttccatgtggacctttagggttttatttgtttttgttttgtggtatgaatgcttaacatgagaagtactgtcttaacaaatttctagatgcacaatatcatattgttaactgtaggcaatatgttgtacagcagatctctgggacttattcatcttatataactaaatttatacccattcaaaacaactcctcacagagggaatctttacaagattagaggcactggggatgcagaataatgaatggggaaacagaagtcagttgccatttaaaattggggaaggaggtatgagctagggagaaggacaagtctaagctgactttctggtttctagccagatggtgatgctatttaaagaacggtggaggctgactatagtggggcaagggtagacactaaaaatttagcttctgactggcttagttttgaagtggatcaaccgagagagctccatacaaatatggagccctacagagaagcctgggttggagaaacaggtgggcagttaacatcaaatctgcagaaatttaaaataatgggaatgagtacaactaccccaagtgtgcaggtgaaaacccagtatagaatacctggaaaagatttatgtttaaaaggatacaaagatgaactagaaaacaaggagtcagaaaaataaagattgaactggaacaatgaagagttagaaaatccaaagacttaaaggtggagcaaaagtggtcagtggcatcaaatgtcacagagaaataagtaaaaaaaacagaaacgcttctacaatatgcttcagatgagaggtcagcgctccagagctgttgttgtggagaagacaagaaacagaagctagactgtgggaggctaaggcagaagaggaaacaaattttttatgtcctctttctaaaggctgagttctgaatggaagttgagagaaagggactgccagatggaaacagaggtgtgacttggccatcagtaggctgaagggaatgtgcttggaccagaaagaggcttatcgtgtattaataataggaaagaattagaaataaactctaggagaactgttttatccatataatggaataatgtgcagactcttaaagatgatagaaggctgttcataatatcagacatacaaatacacaaatgcatcaatgacattacatcatatcaatattatatatcatactatgatgtcacctgaagcataatttgtgggggctacttgggatacataggtgtgttgatcttagggcaggccagttagggttacagatgatgttcctgctttttgtaatctctgattttctaaaattcttatgtttaatatatgtaataatacacttttaaaggaatcaaccccctaagtagaataaacagaagttcaataatagaccggaatttcgggacaagagaagggatggcatccatagcactcagaggtagaaggagatcctaatttactaatttgcaagggaatggggacatctctacattgcaataaaactgtgcagcaatttagaaattctccaaatcagtaatacatgtagaatgagtgaaaattttcattgttaaactatttagacatttacaaaaattttcatatgtgtgccattaagtgtttttgcagtaatctcaaaacatggaaacagctataaggctggagaatttggagtcagggggagtactgtaagggagagggggaaaaaagaaaacaaaactttaaacagcccagtatattttagtcaatgttcctaaatgtcactgtgaaacaaagccacttcagtttctactacctgaaactaaaacacacattaccctggtcaaatgcttgggtaaatgcttgttttcaccgtgaatagtccccatattgttcagcatatcacctcctggattccttaatattttttttcccatcaaatggtctaagccacaattagagggaacagttccaatgtcaaattcttaacaattctcttatccttccaaattctgggaaagatcataggtcttataagcatgtgcccagcccttttcctccccagcatcaataaacaacttggtctgtctcttaaggaaagactgtactttgcctcacagctaatttaccaactatcccagaacagacaatccagctaccaaataaccagtgctctctttacccagatgttgaaggcactctttcttatgcccacaccccccacccaacttttttctcttacactcttttccctctaaaaagcaatggctgaaggacacattagattttaaggtgacagtttacattgtcttaaaatcatcaactaggatcagaaaaatacattacgccgatacacaaaccattgatcatcgcaactgtctctttttttgaatgtgattaaacttaagcatgaattcatttgagagctaggtcctagaacagtggctaacttaagagaggtactcaataaatatttgctgaatggctgaatggatggatagatggacaggtgtgggtaaatggcagatggatggcgggggggggcatgtgaatgcacacacgtgcactgacttaatgcagagggccctgacaatagtattacagtcaaattctattgtaccgccatgtaaaagggctctccgtttcatcgtgcccttctgcaatttcaggacccctgttcactggcaaccacgctgcttctcaaaatcccaagcttgcggcgggcacagtggctcacgcgtaatcacagcactttggggggccgaggtgggcagatcaggaggtcaggagattgagaccatcctggccaacatggtgaaaccccatctctactaaaaacacaaaaattagctgtgtgtggtggtgcatgcctgtaatcccagctactcgggaggctgaggcaggagaatcgcttgaacccaggaggcggaaattgaagttagccgagattgcaccactgcactccagcccggtgacagagcgagactccgtctcaaaaaaaaaaaaaaaaaaattaccaagcttgtttctgcatcagggtctttgtcattgttgttctctctgctagaatattcttcccttgatctgtgcagggcttgctctctcattttattcagttctctgctcaactgtcatctcctcagcgttgcttttcttggccacacgatgtaaaataacaggctcctctctagcctcacttcccatccccttattctctgcttttttcttcatagcccttattatactccctatcttatatgttctttactatttgtcttctccactagaatataatctccaaggggaaaggactttgttacactgtacctccagcaaccaaatagatgcctgaaacagaattatatgttcagttaatatctgtattcagccaaattattccctgcaaaatattttacaaatctaacatctcacccccaaataagttttactcacactagggaccccataattagttgttctccaattgtactatttactagcactttgcatcccttgcccacaatgtcttggacttccccttgaaaattacacatctttggggccgggcgcggtggctcaagcctgtaatcccagcacttcgggaggccgagtcgggcggatcacctgaggttggcagttcaagaccagcctgtccaacatggagaaactctgtctctactaaaaatacaaaattaaccaggcgtggtggcacacgcctgtaatcccagctactagggaggctgaggaaggagaatagcttgaacctgggaggcagaagttgcagtgagctgagatcgtgccactgcactccagactgggccataagagcgaaagtccatctcaaaaaaaaaaaaaaaatacataccactttgtattagttccttgtttatgtgtgcacctcctactctttagcagaacataagctgcctaaggtatccaatagcacggactataattagccttcacaaacaaagccaaactttattggatagcagaaaaagagaaaggacaaaaagggggaaaaactaagtttccacagaatgtgccagccaatatgactgctatacaataggccctctgtatctgtgggttctgcatccatgaattcaaccaactgcagattgaaaatactcaggaaaaaaaaataacaacacaacaataaaaataatagtaatttaaaaatcaatacagtataccaattatttacatagtatttacattttatattatactatgtattgtaagtaatatagagatgatttcaagtgtacgggaggatggacatagattatatgcatagtaatgccatttataaggaactaaaccgtcctcaaattttggtatttgagggaggtcctggaaccaattctctacagatactgaaggatgactgtagatgatctaacttaatcctaaatattctaaagtgtatataccattattcccattttaaatgtaaggaaactgaggctcaagaaaagcaattaaccttcccaacgtcatgtggtaaaattgattttacaacctaggggttcctttcttcattcctagagagaaagaaggtgtgagcccttacctcattcctgtatcatcagaagaacagatgtaatgggtaatatactcatcttctaacaaaaaaaccctaggttttaagtcttactatagctagtccttattaactgtttgaacttacttggataaaccacataaactctctcaaccagtttcctcatttataaaacagcatgtaccacctgcccttactaaatcacaagtttacttggagactgacttcaatagtatatggggaagtgatcagtatactatatagctgtatgttagttccccagagatgaaaacaaagctaaggtatgtattatagaagactctggagtcctctgtctcataatttccgaggccattaaagtttagtgttatcagtttcctctctgcactcagggattccctccatcagagttccaatatattaatatttctattgctttggagactcctattaagcaggcatgaacatctaatgatcttattttcatgtctatttctaaagactacatgtgttgtgtgtgtgtgatttgttgtgagaacattcctgaacttaaaaacatcaataaaattaatttcttaagatgtttttaatgtccatgtaaatacacataagaaaaattattttgtaaatgtctactacagagttaaataataacagaggtttttaaaaataaaaccaaaccatttaatgcataaaactaatctgaaattatttaactcaactacttagacaactccttagcatcaaagacaagtgacagagcaggtctaagctttaagtgtgtagaaaaccacactaacaattgtctttaaaccactagttatttcgaacagctgccaacatgtttccctagaaaaacagattgggatttaggaccttaaaagtgataccagtttggttaaccattcaaaaggaaatttctactcaagctgttaaactcccaatatttctccttcagaggggaaaacattcacatattagttcatgagtctactttgtgtactcagaatagatattctggtcctctaaatggtagatgatgtgatgctacatatttaaaacattctagagcatatggctcaaaaaagtaaacacaacaaacctatgaagtgtacaacagggcaaggtctcattctactctacactaattacaccacatcgccaatactttatttaaattctaggagtcataccttaaaataaatactgattacaatgaggcatggtcagaggtaattggccagattttaactcatcacaagagaaaatacccgggctgagcgtagtggctcatgtctgtaattccagcactttgggagaccaaggcaggtgcatcacctgaggtcaagagttcaaggccagcctggccaatatggtgaaacctcgtctccactaaacatacaaaaattagctgaacatggtggtgcatgcctgtagtctcagctactcaggaggctgaggcaggagaatcatttaaacccaggaggtggaggttgcagtgagctgagatcaggccactgcactccagcctgggtgacagagtgagactgtctcaaaaaataaaataaaacaagagaaaatatcctacctaaaacagaaaaaggaatgaatatttgatggcataaaatcagggagactttctactgcttccttctctagaaacaccattcttaaaaggttactaaatcaatgtgtttttattataattttaaacaaatgcttttaaagttgctattacctgcagtaagtgccttaaacagtagtagcaatagaaaaaggaaagcttatgatctgccctcaaggaggttacagtctattctggttataccctttctgattatctcatctgcttcactatacagccaagtgatttcatcaataacatccctaacacctcccctactcgctcgctcaattccagtgatccataggcactccactctgtttactcttttttttttttttttggagacggagtcttgccctgttgcccaggctagagtgcagtggcgcaatcccggctcactgcaacctccacctcccgggttcaagccattctcctgcctcagccgcccgagtagctgggctgattacaggcgcccgccaccgtccctggctaatttttgtatttttagtagagacagggtttcaccatcttggggctcgtctcaaactcctaacctcatgatccactggcctcagcctcccaaagtgctgggattacaggcgtgagctaccatgcctggcccactctgttttcaaactaatacaaatatgagttctttctaatttaccaagaaggttatgtattccagctctgtgattctggactatactataaaaagaagggactgaacttcatgatctctaatattatgatattcttggtactaatattctagttcttagaatatttgctctaaaattatgtatttctgtaactgcattccggtgactttacacaggtaaaaaacacaaaagagcatttcaaaaatctcagaaagagtaataatgtccaatagcgtcaattcaaatgtgcctgctgggatatctaatccactgaacaaaattttaaagagtcaggtgtgaatattatttccttacttaataagaaagaaaaaaatctgaaagcagacacatgaaaacagatttttccaaataaatttttgccttaataagtaatttcctcattgaataaatgtactgttaaacctatagaaacttgcctagagtctacctataaagtcttgctatattaaatgtgtggtccaaaacaagggaggaggtaagcccctggcaagaaaagggctaacccaactaacgtgccattattattagagattagttatgaaaacttaaccctccattgatcctcgattccacctttatcctgcttctcgaaataataggcctttattcctcctgtttcccaatgtaaagggaaataccacgacaaaaaaatgacactctggacttgtgacatcagtattcatttcatctcaaacactgaatttgatagggaatgctccacgttattgatttcctaaacatacttcagagtcccaaggttgtccctcctttccacgccagtccttccctggctggcatctacatattttgttgctcagaggcatgctaaatcttccctaatgctgcactttgcccagaatgtctgactctcactacccctcccaaccacaagttcatgggtccagaactttcctatccagagaaattccactacaattgcatccaaccatggtcttgactcataagcctataccaagtttttgctcaaggcctctctccttttagctgagactgtctggggacactgaagagaatttctggccttgtaggaagcaactacaacttcagggtttctatgcggtaaaaattcctgtaaactgcctgtatcctaatctggtctggtgttgggtaggatgctcatcaatgacagattcataaaaatgaaaggaaaataaaagtaggggcaataagggtattcaggaaaaaaacaaaaacaaaaaaaacaaaaaaaaacaaaaacaaaaaaaaacaggggatctacaagagacccaataaggagaaggttttgttgtcctcagctgaaaacgctgttctgctctggaataaactctcagaattcatgtccacgtgaaatgtgagcaccagaatgcttcacctataccataagcattgtgctgatgctgcctacaccctgcctattcttagattcagaatatagtgaatcttaaattcagaataggcaggttataggcagcattagcacaatgcttcatggcagaagcagggaagtgccttagatatcacagcaactatcctaaactagacctgtaacttctttataaattaaggaagtaccttagaaatcatagcaactttcagccgggtgcagtggctcacgcctgtaatcccagcactttggaagtccaagacgggtggatcacctgaggtcaggagtttgagaccagcctgaaaaacaaggtgaaatcctgtttctactaaaaatagaaaaaattagccaggcatggtggtgcatgcctgtaatcccagctactccagaggctgaggcaggagaactgcttgaacctaggaggtggaggttgcagtaagctaagaccgtgccactgtactccagcctgggcaataagagtgaacctctgtctcaaaaaaaaaaaaaaaaagagagagagagagagaaagagagaaaagaaaggaaagaaaggaaagaaaagaaagaaagaaagaaagaaagaaagaaagaaagaaagaaagaaagaaagaaagagagagagagaaatcacagcaaatttcctaaactagacctgtaaattctttgaggttgagcagttcttaccatcttattttaccatttgacactattttatgctactaagcatgaaagtgtgtttaatatttgactagcatcatgaatttatagtcaagactgattcagagatatgaaaatgcataatgcaagttaattttctaatcagaacaaaatttatttcctctgaaaccaagccctggaactgcacggatctaggcactctggagttagtatcattacaaacatgatccttactaagtaggcatttcatttcttaaaaattataatcctaaacgatctgtaaacaaatacttcctacctgttgaacctctcctagtaaatcatctgtaactaattgaaaaaaacacatatttccatgattagtttttcagtcatacttgcaataaggacttccaggattaaaaatattaaagaaactatctttaaaattttatctggtaaattatccccatttttttccttgtgccatttcaatgcagatatttatttgttaaaacacagtaattttaataactacttcattgacaactactttcaatgagttatttcttgtataaaatttgaattcatatttcaataaataggagatcatgtgggttttttagaatatttttcccataaaatacatttttttttctatgaagagctaccttctaacatactttcctccagagctatagtttgccagagggcatctctatctatctgattttggtctcatcttcagttctctgttttcttcactctggtaatgttggcattcccttgatctctgctatgtccgctgcaaatgttctctcctataactctatatagaaattttatttggtttttctcaacatcatgaatcctccaataaagcaggtaggtggcattaaagatatttaacgtgcttcattaaaagagagaaacaacagcttaaaaacacacgcacagaaaggttaccgaccaacactatcaattctctaaatgctacaatgcaactgacaacacagtaaacaacatctaagctatcttggcaattaagtaaaaacatctttcaagaaaccacaggtcagctttcattactgagactcactgggtgattctggagctaaacacttcaacacacatccagcagacctgttttcctagtttaaacatggtatctaaacagcaaatatatctgttttgccgcccatctgaaatgtagtctacactaatctatacaaagccagatgcacacacgttttgaagcaatatattcttaacaaatttttcatgttttgaggaagtgctaattcacttaaatgtagttagcattattcaacctgaacattttgtttgcctgacatattttgattttttttctgcttcagtctacagttaaaaaattcacagataaattcaaatagttatgaactagtaccagagtgatattacactctgaaaaaatttaaaaccaataaagaacactgtaggcttcctatttccactaaaaagctaaatactaatttcagaaaagcacacatcactcagatacacatacacacacacacacacacacacacacacgcacacacgcacacacgccgatgttataaaagtactgtcactagaatacatgttttggttgtttatccaaatggtaatgagatgtgatgatctaccttctttagccaagtcctcttttgtaataatagcatccatttatttaacagctaaccaaaatttggagtgctgtctatgtttattcaaggagtttttccttttgcaaatttaaccggcctatacaagaataaaatccacaatcaagctcttgttagttccatgatctcctcaactgagattaggtggtaaaaacaactaaagcattgttactgacaagataatcaacattgtagttaattgaaaattaacagtgggactctccacttagtgccaaatgtagtaatttgaggtggtcatccttaacagtccaagaaagtcgatttccaattatcagaaagtgaggattatctgagcaaataatactttcaacttcttcttgacataattaaattaaatgagatagccttttgacagcattttctttctagcataaattatttagatataatcaaacaagaaatgttttgaaaccaaaacatttaccacatttgtaatatgaaagttaagaaaggtatagttcaagtttatatacagaaaaaaatatagcatatgttttgaggacctactatgtatggggcactatgctggatacaaggatatacaaagatcaacacaactttattcttgccctcaaggagagcatcttttaggtgggcttacctattctccactctatttgcaccccaaaacactattcaagaactcaactaaaactccatcccctttttaaattcttccttggttttcctgtcctctgtgattccatggcacaaagattggcatttatcacatcaagcaattattaggtacgttcctactaagtgccagacgcaatggtaagtgctgagacctgaaagatgaacaggactaaacctgtccttcgggaagatcacatttagcgaagctcccatggaaagaccagcttatttttatgcaccttgtttttcttctaaaggaaggagacctcactgggagacctcactgtgttgcccaggctagtctggaagagatcctcctgcctcagcctcctgagcagctgagactatagtcacaaaccactgcacctagcttcttcttatgcatctttacactgccagcccctggcataccgcgggagctcgatgtgttaattaagtatcctatgaaaagacctttagatgagaaatcagaaaaccattgtgacactctgggcctcactttttccaccaaacaatgcagtcattgtcattctccgatatgatctcagggtataccatacatgagtgaatattctgatttcaagtgagagtggtaaacatacttaacaacgtcaggatgtactttaaacaattttaaacccctctaagctatgattagttcaatgactaggcctatgctaaaataccatcttgaaacattattgtagccattattgtggaatttactttctgattttgatatattgagttcttttcttgtctccccttatccacagatgtataatttgggtctgctgtattctttcaaaggaagaattggcagggtggttgctgttacctagggtaagtgtgtaatctctttgactttctcttgttgggcaaactgcccagtgaatatcaatttttttagagctacaaatacggttttaatagattcacagattttaaattattataattcagagcacgtctctcccagggtgagcaaataattcacaacaatccatgagatgcaaaggagatgacaatggatcaatctgtatgtgagtaagttgacgcagtgctttactgttccttctgtctctacagaccccacccccctcaagacacacgattttcatatgaaaaaaattgctttggtgtatgaaagtttaaattagtcataatacccactttggggactgaggaagacttactgtaaatcagccactcagaaaccacatttgacatattttggttataatgtaactataagttgcataatattgtacgtattgattggagcctgagaatataatggaaagcaactgccatatattgaaagtgaccaaccacaagataaaaaattgttcctgaagagcccactaagggagtaattttccttataatctaaaactccttatcctctagatggaatattctatcacacccccaggttacattttgccctaaaggtgctaaggtatgttaacctcaaataatccaactatccaactccctcagatcaagagaaagttctagcagagtaaactaaatttttcctttattgaaacagtactggctattgtgaattggagcaaaatagcaaatgagatgcacatctcactagacagcaacttccaattggttgaggatcttataacagttataaattcttagtagaatcaggccctctgttgtttctctgtcctggtcttttacctttaaaatacaataacttattgagggaattaaagtatgtgagatactatgttatgcattggcaaggtgttccttccatctacctgcacaaatagagaactacttcttctctaactgcttaaattatcattcctataagcagtacatatttctttaaacagaaacaaccagaaagaaatcagataccacggaaaaagaaatgaagatcagctcatccacttataagaagcaaaaacgtgttagaaacttgaactgcagcttagagtggacggtaggaaactttgatgtggtttcatctcctctgcatgatacatgataatagttaaccttataatttgtggaccatgactccaataaaaatatgtaactacaatttaaaaacatataataattgtgtaattcaactgcttttgttagaagttggtttctgaaacagattcttctatcaaataagtactgaaagcatgcataatgtttcaatcccactgggtactatttttagtttttccttacactcttctctaaatcttcactgatctatcatatgtcatggtttaatagaagcattaactatacctattcgggttcctaggaccattggaaaatgccagtaaagatttgggtctacttttgaacatctgaaagagccaaattaccctgtggcagaattctgctaaatacctctatttagaatatacatatagaatataaacataaataaaatatattagagacaaggtctcactctgtcacccaggctggaattcagggcgcgatcatagttcactgttcccttgaacttctgggctcaagtcatcttcccacctctgcctcccaaagtgctgggattacaagcatgagccactgtatccagccaatttaagaagaatattaagagtggctgaatagctgacaactttctcccactccaaaatcaaggacataggatataactgttttatgctttagtgtggataaagcagtagacttgtgttaataaaagggaaatgcgttacctattctagatcattctggtcctaatggtgaatgaccaatgttccaagaggtaagataaaattattgaaggaaatgcaaacaatcccttcaagtaacaaagtgatggtaaaggtatacgtgaactcacctgagaagtacactacaataaatgcaagaaaagagaaattcagaacagcaaatactccagagctctctatgcttttagaccaaaaccaaaaacaatgtatgggttccttggactacttaaaaatcctctctgtcacgtctcttattctagccgcatgaaccaacttcccccactgatcgctaattagcaccttcccctgagcttgccccacctgagtcatgcttcctgacaacctgaagacgcacatgcacaagccaaaaagtgtgggaagttcatgctcagacggccatacggatcaagggaaatgagagccaatggttaaatatttcctcagaaggcctcagagagaatgagaacccatcagttgtggcactgatcatctcagtaattcatctttgtgttggttttccctggtccttcatttctactctaggatcctccctaaacaaaatgccttcatgcaagtcactctctcaactgtttacataagggcccacatcacatcggctcctcctaaaagacatcctaaaatgtatggataaaataatatgtgattgcatcaaaatgaacgaaaaggtgaagcaatgaaataactcacaggaaaaaggaaaggataagtggtaaaaagaaaagagctagggaagtgcagaaaggctggagaacacatctagcctttcacatccaaaagaacaggcagcccatggaaaagccaaactcaggagacaatctctgtacagtgcctttaccccaacatcagcctttacctttaccacgaggggttctgtttgacagaaaattagactatatcccagagtttctcatcagctctggtcctatgcatcacttccaaaatagaaactggacatacagctcatactgtttactcagctcattgaagcctgcctcccatgagatttgagaagcaggctctggttggcaagtaaaggagagcagttggcccaccgttagtcacctctttaacccagaaggcatcttgtttcaccatatgcctgaactccagtcagcagatcctggttttaacactggtttgacaagtactgttctgaaaggcttacagaaaacagacccaaactccaccaaatatatctacatagctcaacaatgactgaaaatgcaagttgcataatctagaacagagccaagtgtaacagtgaaaatatacctgtacatacattgtaaggttgtcttatgccacagtttctctcattaagcaaactctgaacaaatcattcatgggtgattggtcacaaatcttttagtggttactgattcacaaaaccacagaaataatacatactctgctaacagcaaggggtgttgctatggcatcacagataatcacaggtgaaacagggagatctggggcactcctatgaagatgagacaaaagatctttaaaataatacatccaaatatctgacatgtcaaattgaaaatgtttaacattggccggacgcggtggctcatgcctgtaatcccagcactttgggaggccgaggcgggcggatcacgaggtcaggagatccagacggtcctggctaacacggtgaaaccccgtctctactaaaaatacaaaaaattagctgggcatggtggcgggcacctgtagccccagctactcaggaggctgaggcaggagaatggcgtgaacccgggaggcagagtttgcagtgagcagagatcgtgccactgcactccagcctgggcgacagagcaagatccatctcaaaaaaaaagaaaatgtttaacatcaactatagaccaatccagagcaaaaaatcctaactgttcaggacaaaatgaaatcataattacgattttatcgtatcacactcataatcaccctatgcataatcctaaaagaacattgttctaaatccattctctttatgagattaagtaggaacaacaaactccagccatcaggctccattcataaaaggttttacaagagagattacatgtgacatttttttcctacaatttattagttactttattggacactgtcgccaaattctgctaaagagtaagagaacaccatggagtagtgaagcaatctaagagcaaggtaaataaaatctacatctttaactttccaaaaacaaagttctcatttggggacataaagaaaccaacttcacggagtcaaaggaatagagacaaggaaagaaagcagggtaaacaacacgaagcaaaaatcctgaatcaaatagtaaataatgacgctgacaattttcctacgagctggaatccctgtttagttttgggggggttttttattttgttttgtcttagtgtatctgttttctgctctttaggtgacaggagtgcattctcatataaaagataatgaatgatgcttgcatgtattagacatagacttatatgactataattacaaacaaaattcctctgcatatcaaagggagaaaaacctttgtttattcaagaaattcctaatggtttcatttataagtaaaactttctctttatttgagacccagtagcatagcacagtatagctggaagacagcaggtagctcttataataaactttgcacagttttgaggaaataacatctgaaagcacttcattcttctagggtgagtagatgaatgattcaaaaagaataaactcccagggaacattctgagatttaaaaaaaaaaaaaacacacacacacacacacacatacaactgagaggtggaggcattcttgctaattaaaatttccagttcttatggtcttctatatacacaagtcccagtcaagaaagatctgcaggatcaggcctgtaccgagaaaaagtataccatcatcacatcacattaattgtattattacttcacaaggctaaccagccaggtttatacagaatagattaaataacaagataatctcataaacaatgatcatttcatcagtgtaccaaataagtttgatttatatctttgactgttctaattaatttctgcatccacatgctttaatttacacagccagacacctacactgcagtagggacagccatttttttaatgtgttgaactctgagacgggttcatgtttagtctccccagcgttgctgttttagttcccctacacttaaaaaatgaagtgactgttataataccttgcactaaaattgaagcatgcagaaagaaaatattttatcaaactcaatacctatctctcttgccaacattttacatttaattttagttgttatagctttactcaaacgtacaactagaactgttcattccaaagttctgaacctgccttttcggactaatattccactcaaagccttttagatatataagttcatctcattacagcatcaatttcatatcctcatctttgttttagtgcagttcccagaggcttaggggacagctaattttaaaaacatatgatttctaatcacagtgagggtctggataaaatttttaaactgtcctctagaatgctggtttacaacagcaagtactaccattgaatagttagaaataaagaaattccagagatggaggaaaattaatctcatcccaatttcctagccagaaagacaaaaacatccctgaatccagacccacttacaatacaccatcagtgacatcatattaatgtcagcactcttttaaaacccctaaaaaaaataacaatctaaaggagtatcctggtgtcatgattattttagtttagtcattttacaactcgcatggatagtctcagtgtagggaagaagatgtgtgtttacttatttaatcaggcaagcaaaaaggtttttacttgtctttgatatcaaacttttatttatggatctaatcgatgtttatttgtaggactttaagacaataacagatatcagctatatcatctgtttttgattataaactcctagagggcaacgaccctatctattcagctcacttcttataagatgtaaacatagtaccatacccaagaaggcacttaaagatggtttatataacattgatttcaaggggacttggtctgcgtatatgctccttgaagctctccactggcactcaatgaacagtagagatttacacttttatgttcttgggcaattccactgttcagttgtctataatggcagttttgaaacagattattagatgggaatatttccgattcttaaagtttaagaatcggcatttgagcaacacccaaattctaaactaactgacactagaaaagtagaagggaaaaaataaaagcaagacccaaatattccatttcttagcatcaagctagcacatttcacacacagtgcaggaagatctgctattttcacagggaaacctgccaagacaactactacaatgcctaaaaatgtagcctccttgcattcttcttcacctttccctcacctttcctgaggtctaactgatatttacatcctttatttaagtccacttggattatacaaaacaaggactaaattgagttaatttttttttttttaagtctcactgtgtcacccaggctggagttcagtggtgctgtcgtaatgtgatatcgactcaccacaacctctgcctccgggctcaagtgatgctcccgcctcagccttcagaatagctgggactacaagcacatgtcaccacacccagctaatttttgtatttttatttttagtagaaccagccttttgccatgttgcccacactggtcttgaactcctgggctcaagtgataggcccacctcgcccaccttccaaaatgctgggattaaaggcatgagccactgtgcctggcctaattttcgaagaaaagaaaaaatttagaatactgctatataatacttgttaaactctaaaggaataaaacctagtaaattgtatcttaaagactctgacacatcagcaatgaagaatgtgttactaactacgtgattttggttaagtcttaaaagttctctaccttagtttccaaatctgtaaagatattaggttacataacttaagtaatttccagctttggccgggctcggtggctcacaagggaagccgaggcagatcgatcacttgaggtcaggagtttgagaccagcctggccaacatggtgaatctcagctacccatgtgaaattttgtattttaaaatacaaaaattagctgggtgtggtggtgcacgcctgtaatcccagctactcaggaggctgaggcaggagaatctcttgaacccgggaggcagagattgcagtgagccaagatttcaccactgcgctccagcctgggtgacaaagcgagactctgtctcaatcaatcaatcaattccagcttttaatttcgaaaacatgaaaaaatactgatcctaaagaattgaaaacacaaattgagattccattatctactcaaacaaaagaatttttctttttcttttgtgtacatgtaggagggaatgtgtgctcttaaattattaattatgactaactccaacaaaatatttgaacagaacatcactagctattcttatataaaaatatggatatatacatatatatgacatgtgtgtatgtacatacaaaatccatgcataggcacacacccaaacacaaacgcgtaattctatttaagccaagaattaaaacattttgtttttctctatgttttccttcttctatgaagctgctatggcttaggaacatacataaacataagcatcttatttaatacttcttacattaatactggcagttgccaacatgaacagtgtatgttaagttggttgtccaaaatctaggtaacattctctcacagaaatattggtattgagagagaatgcagaaatgtagttaagttctcaggccattcaaccaaagtttacttaatccacaatgtatctgacatatagaacctgagacacaggaattcacaaatttaatgctgcctaagcagatgctaagttaaccgcagcagcggaataaagaaggtctcgaaaatatgtaggggcatccagttcacaccacacccaagtgagaacaagggaggagaaaaaaaaagcaagttcatgaactgtttttttccctgtaaatattcactaacacacttctgaaagaaagcacaagtcactgttgaagatattatcattttcttatttgttttgagaaacagatgtattacagaaggcgaattaagaaagataaaaagaaaaacatagttatcttgttccaaaattttctgtgttctttagattccttattttagggaaaaattataaaactgtttttaggtaaataatatttaatttttcaagatatgtgaaaatttcagaaaaaaattctgtctaatttttatgtgcttggccaccacaagctagtaaaagtaatttacacagtaacaacaatgcattcactattagccaaaagctaatacacaggcacaatctccttcaatctgtccgacagtgtcaagagataggctgaagaactcatctttctatactatccatcaattaaaataaaatttaaagataaaaacacacatggccaggcatggtgcctcacacctgtaatcccagcactttgggtggctgaggctggcagattacttgagatcaagagttcgagaccagcccagccaacatggtgaaactccatctctactaaacatacaaaaattaactggacatggtggtgaatgcccgtagtcccagctactcgggaggctgaggcaggagaattgcttggacctcggaggtggaggttgcagtgagccaagatcgcgccactgcactccagcccgggggacaaagctagactttgtctcaaacaaacacacacacacacacacacacacacacagtagcaatatcctgactactggtcattctattcaacttcaaacacgtctcaagttaggggaaacacaagtgtttcaacctgaatgtcttcctcctgtgtccggagttaagaagggagagggtaacccagagctgcaaacttctagctggctttcactaataacaatttcattctggtccagggaagaggataactcaatgagtattctgcattccttttaaaaagcttaatcaaggttcaattgctttctttcaaaaaattcgccaatggtcacacaactttatgtaaaaatgtaacctaaattttataattttacaaactaagtaattatagatataaatcttttaactagtagcaggaaaaccaacattataaatgaaaatggaattgcagttcactttctgtgacggtagaggatgagaatcaattgtaacaaaaatgagaggatgcaaaataaaaagagagaataatggaaaggaaaagagaaaatggagagagaggaggaagaaaaaaggcagcaggtgacagtgaataagaaaggcagtaaggtaagggagggacgaaggggtgaagggagataaaatatttttagcaaaacaactcttgtccaaatttgccgaagttccagaccataacttgtaactgttttctttctttttctttttttttttttttttttttttttttttgagacagagtcttgctctgtcgcccaggctggagtgcagtggtgcaatctcggctcactgcagcctctgcctcccaattctcgtgcctcagcctccaaatagctgggattacaggcacacgccaccatgcccagctaattttctgtatttttttattagagacagggtttcaccatgttgcccaggctgctcttgagctcctgactcaggcaatccgcccacctcccaaagtgctgggattacaggcgtgagccaccgcgcctggccatgtatctgttttctgacagaggtattacctacctctccagtaatttttttaaaattctttctgtacctaaacagtaacagtctcttttttttttttttcaaatttccatgattgtttttacataaaagttcaactttgaaagcttcacttgtgtgtaaaggaatggcttttattttacaaatatactttggaacctacacaccattgatccatttagtgcacaaaaactcagagttgtcctgacattccaaacccaacagtttttcctttgtaaagaaactggagatgtctccttcggtagtgcctgaaaattacaatcgaaatcagtgttcactgattgtgcaaagccttataaatatgttcccttgcttgaggagtaaccttctatcgcccaagatagttgtttttaatagcaagaaaacaacatggatgggcccaaagtgtcagaggctctcacaggaacattcgtatctggtcatcagagagaaactgtcctccaagctgcactatgtacacagagcgagggcacctaatattgcaatcacagccagactctatagaaagctacactgtgcctcaattcagcctggcaaaacacctcccacccacctcactgcacctttacctggtggcttgcttctttctgcccatccacctacacatcctctctacctacccataaaccactggtccttactatactccataccgtaggaatgttttataatataaaaattcattaaataatataccacttttgatacagtgatcctacaaactgtaactctgtgaaatggttcaacacgatgtcatcgctatacagcaacttgtttcatttacagtatctgtttcacttctactcatgagctaatataattcaatttcttttaactgcacacaggctgctagacacatgtgcatggcaaatggaatctgaacttagcttaacagcctcatttattcctgatggtttaaattatttcatcacaattaatgacaccccctcagcttcctgtgcagcgctgccagatgttcagagaccacaaagccactctcttctttgacggctggtgacaagttgtcctctgaaggacgttccctagatgcgcgggccggatgacacctccattgcttagcacctctctgcctcccagagtaaccatggagaggaaaaggcaggaaggcgtgagaaaccagcaaatgcattagcaagggcacattatgtgaagtgatctaaactcggaggaacttggctcctgccagaggagttcctaaccttgttgttttataaaagggctctttgcctccaccttccaccactggtatccactgagtgcctaccatggcgtcagtcctcagggaaagtcagaacaataatcatacaaacttttccacagggatctgtttggttcttagtaattttgtttcgcatagggggagtgttatttaaacttaacccctccatcatgatcttcatcttctttttaagggtaaacagtttgaaatcactgtcctcatgttcaactgtgattatgttctatcctattcagtgaaaactttcaatagaaacatacaacattttggcaacttgtggtaaatggttttccgccatttacttaggtttaggaggatttaatcttttcaggggcttttgttgttgttgttgttgttagctttgtcgttttcttaattttttaaagaaaatattgaaaaacaggcttcacactttttctatgttgattctgatgtgggtataatcacttacctcctttaataacaaaaaatttttcctcagtacgggaattcagaaataataattatactcctcatttaaatttcatataaaaatataaattcacataatcacaggtagctaagaaggtagcagaaatagtaaacacactaatacttttacaataagaatccaattccacaagtctaatttggcaaacatttccataaactagagaacatgtggcagacattttatggattattttttaaatgtttaaaaaaaaaaaaacgttgatcttattcagggaataaggggcctttccatttgccaaaaagtgtaaaaggaaaacagacaggccacctgtgtcagcccaccctatggtatgaacatgagctataagggcattttggaaaatattttcaaactgagatgagaaaaaaaaaaaatcagtatcaatacagattccaagcagatgcaaaaggcttctgtgcatgttagtgattacgtgtgtggcctacacaggctaacttcagattcctctgaaactcagtgtactttctcttttttaagctacttgtgattaaaactagagcctcatccatatcaatttcgacaatggacacaaacacagagtaaaccaatcaaaccaaataagttgaattttctccctcttagatggctttttaaattctaaatgactactgaattttaccagacactccacacttaatattttgacagctgttgattaaaattactttactgggaagtcctgtgaaaccaacagtctagtttttatcagaattgaggcactcaaagggaagctgagatggtggcatacttgcagcaagcagacaataggaaactcttagcactcccagagttacgtcaaattttccatggaccgaaactaaaatgaaatacttcaattactgagaggtagataagtaaaataaacaattaatttcatacggtgaagtcaggagagagtcatatggacctcattctgttgtctccaaacattttatcggaggggaaaaaggagctgaataaactttaaactctcatgtagggatgtattgcttgtgtgtccctggcagatgtggaaaggagatgaaatgggcaagggagaatcaaatatcccatcgctgcaggtttgctgagggaaagagcactgcaaagatctcacatctggcaatcatttgtcaatagctggaaagagaactgcaggaaactttctggctcttggagaagatgaaaagacaaaaaccatgtgtcacacacacaaactcacacacacactcactcactctgcaatggtacaatgactactacacttattctctacccctcccttcccccactaaatttaatgatcttcagatatactctactccatggtcaaaaacatgcagtcacttgacttgttaaagctgcagtgtatgtacatttttcaaataaaccgcagggctgatgttagaaaatcaaaatcagtcaagcatagaccgcctggtactttgggcaggaatccttgcggtttagtcaataaacagaatctgaatgaaagacaccacagtaactagacagtaacgttttgaacagatcttaacctgaaagagggggttgggggaccggtgcgctggtgaccaaggatgtaaggctactggtccacttagactgctctaccggcaacaccactttgtttagcacaaggtcatctatttggaacagaaaaaaaaaagagagagtgaacttttatttggggggatgttgtggatgtatctgtgaaggaaacaacctttttttaaaaataagttatacccatttaataaggtggtaaggagaacttcagattttgtttagttcatactgttgttaaaaaatatagagaatttgctggcttcattgtgagttcataaacatgaccagctttgccccagtaggtttatcatgtaataaaaagtttcaagacaccctatacaaaattaattaacttctccaacatcataggaatttaaatccgttcatagtgatcgacagacttcgatgagcagcttttggttcacccttatgctgcatttaactagcagcagcagccgagctcatctccgtgattccagaagtgaatgctgcaggttgtttaataacctggcaaattcacagtagcttgtcaaattattacaggaacagtgtcatcactaaacaagcctgatcacggttaattacaatgcagaccagagagcagccacagttgttcattaattacaggaagcacctcatttaacttttatggaaatttacacttgcaccccagtatgtctggaaaaaaaagtgatcctccacgcattcacataagaaaggagcctgtggtttataaaacatcacagcaaattgtgtctaatctagtactgaaatattggttcattatttactctaattttttaagcacttcagtggtgaaaaataccaagtcaaacctcacatcctgaattcccaaccaagaaaagaactgtgctgagctaaatgtaacaacttaatacatgatgaggcacaactgaactaacaaagtaacttttctctgataaaagtaaaatatcagcaattaaggagagtctaaattagaataaccatttcttagaagatgattgcataagagtgggattctttgctgctgttcatcagttaacctcccaaactggagtacccacttcaaaagccactggggaaagtaaataaagttacagaatcaaaatcttgatttccagttatttttctgaatcaagcaatattaacacaaaccacagcagaagtccttgcaaaagtcaaatcaggcacagacttgaaggttgacagtcattcaaaaccaaagatacattcattgaccacagtaggggatcttgggattattaaaaataaagctgctaagaaatctgaaattttaggaataaaaggcaaaggtttaaaaggaagaaggcaaagagcagaaaggggctccaccagtcatgagaacttacgtcagctaaaacataaaagtaaaccagatttcagggctgtatgtctaaacaaaaatcctttctaagaaagaatataaacaaaccgctgctcctaaattgaggtgtacggaaggttattctcagaatcaagaggccaaacagcaaaacctctagtgatgataatgcctagccctggggcaaagcctatgatacaagcaggaaaaggagatgactggcaagtcctatagtgagctccctagagtataaagctatgctgaacaataagaaatggctcattctctaggaaaaaatttaaaaaggactaggacacatgacatggcaagaatgaaagcagtctaagctaaaaaatactcctgaaatagatagctggtgaaaagtatattaagcatctttattatggtggacataatatgtatatgtactaggtatttctaaaatgtgcagaagaagcacatttaggaaggcagaagaaaaagaagagaggaagaaatgcttcaagtgggtcccagctacttgactaactctccatagctgatcatcttttaacagattcaatccttccacgcagtccaccaaaatgatgatccacaatgaggaatatccaataatgtcactttcattactttgtccaggaacttagtcttctttgcaaggtcctttctgaactatcaaccccacaatctggttcatctacaaccagaatgttactttaacctgtaaatataacattttctacattttctcccatagtatgtcaatgtactcaataggtttttttttccagttttattttacacactcacatctgcaaaacccaattttcttttcactgtaattcaaggtttaaaaacagatttccaacaatcacccatgacagaccattccaggtgatgtgtttgaagaacatcactcgtcctacccaaaaaaggtcaaggatcagactactctccacaaaaagtcttccatcactctgcatttgcatgtcacacacaagctgttagctttctagaactaggaaatacatgatcgtgtctcatgtgtcccacctgcttttctgttgtatcacagacatacaccacccagacagtaccagtttggggcacagcagagctcaggtggtcttccctgggccaagagcaggtgtgctagagatggcatacccttcggtaccataaaaactgaaacctcctcctaccaccacttctaccctcattctcactgcatagaagtccattttttaaatggttctctcttctcatttgtggttctaaatcagtaaaaacgttttaaaactgagctcactatgctcatcttataagcctgaaaatttagaaaataaggccaaatggaggtcctaaaaaaaaaagtatgagtttcctcatgctagggagtgctacccatgttgaaacttcagcctgcatctttgcattggcacacacattccttaaatattattatgtacatagaaatggaggcatgcctttagccaaaatgtcacatttacatttttaatttgcaatacaccaaatcacttctaatgcctcaagaccatacaaaacgaactgaatttcaatccaacagtttcaccaaaaaaaaaaaaaatgtactttgctaatatactcctattacaccacaagacatatcttccaacgcatgaagacagaagatatttcattaagtcctgcttttcttataaagcactcagttgaatggctgctgttctcctgagccgggagaccatattgtaggaagcatgacttactcacatatatcccaaaagtcttagaagatgaaagctaatatttactgggtacctgttatgtgccaggtcctgcactaactgctgaatatatgtcaggtcctttaaattctcatcatcaccttgtgtggtaaatctccatcttacagatgagaaaactaaggttcacttaaattaagtgacttgccaaaggtctcacagcaacttgtatcaactctaggtagtcaaccttcagagaccatgtacttactacagtatgtatatatgtcttgactgaacagacaaatgatctacagttacagacaacgcatcctgaaaaggacctatggctgcacatacgctacactggttcctctttacacctaactcaatggttgtcttttcctgatgacgctgatatacccaaatggctttccaggaccactgtttctgtcacaccacccctagctgagaaaacagttaagactctaacctggacttccagcctgtggtatggctcctccaggtttgggcagaagtctgcccccagcactctgccagtacatgccaatggaacctgagggaatacagccacgttagatgctgtgtatggaggctgctgagaactgcacacagtcacacttgacccaggcagagagaggaaatcccaactgcgggtctctaacaggtcatcatggcttgacatgtatgtgacacttagtatgtcaaatatatagtgaataccatgtaacaaagtttattaactaccagaaggtaaattccaagaagaaaaaagcaacataaattttgttcctccttgtattcacagcaggtagcacacagtaggcacctaataaatagccacggacaggaggagggagacagaaggaaggaaatgcagggatgggaaaagactaaaatagataatttctgtttcacattggtgacataaattttttcttttcctctttcctttaattttcttatgtaggaatttaaaaaaaaatacattcaacaatgcctaagttcctttacgttcttaaaatatttgttcaaatttatttttcctgttcctggtgtaggctagcacaggcagacttctatttatcaatatttattattaatagttactcatttaaacatgttatctttaagcttaaaaaccttgttttatgtatctgtcctaataataaaaaaacaaggttaaaacttaatgaatgtttctctatatctaaaattctaaactgaaagccactaagatccctttttaaaactaagctattataattagtcaatatcatccctaaatactgcctactgtcccttgcttatttcatttcagatttttttaagattaaacaaggttttagattccacctaaacatgttttctgctttttaaaaatttctaattgttcctcattatttccatacttatactactcacactaatcatatatctgtctatatgtctctaaactcaatacatcaactaagcatcatctcacctttgtcttctttccctatcaaagcactcctctgttttgttttctttgacttttttaaaactccaattaagatcatctgtgctaatcaatttgctttgttcagacatcagttttcagccatgcatgctagcttaaaaggtgcttccctctttcttttcacccaaaaatcagtacaatcgtccaaacttaaacaacgttcagtatactccactttgcaagttcactagtgaatatcactggaaagaaaagaaaaataaaaggtactcggtcaacgcttcaaacatttttaggtccagttctctcattcttttcaagtcttttattcttctttactaggctcataaggtgaaatggacagagtgtcatctgtctttgaagtttacaaccactctttacccaagagtttcacacgtgcaggccaatgcgcgagtcactatgtggggaatcttacgtgtagattaaccctcattttcctctcaacactcttacggagtatgagcatctccagtctacaaacgaaaaaactgaggcttagagtaggtaaataactagctcagagtcacatgttattaggttgtaaaacctggattcaaacttaagacatgagaaagaaaagaaaggttgagaatacatttccaagaatttaattttaaaaaaaaatgtaataactacatttagtggcatccattctagaggtatttgttgatgtttcatatgaaagaaattacaaagaagacaacaaaggaaaaaggcgctaaccgaaatcaagacctgctacctgctccttggtctaggacaacataagtaacaaaaaagggaatttatcctcttaactgaggaataagaaagaaatgcagcagggagaagagcgggggcactgtgcatttgtgttgtgtcacacatagaaataatgctcattctacccctcagctgacatatggaaggccactaatgagttctgcaacagtaattctccccagggagcaatagaagggaaaagaaaaaaattaacctgagaatattccaaatcaaaatgaatccccccaaaaccttattataaaacctcaataaatgggacttaactaaggcagattcagtaagccatatattgcaaattaagtgtaaacctcacccgatctcacatacacaaaacaaattgctacttaccttaagattatttgaccacgtcacaaacactaagtttctagttctttttatcttcacagtcacagaatgcactttataaacattctcaagagggaaggagaaagttaaacaactaaaattacatgcaattacaacttgagacacttagaaatacactgtttctaagagaaaacataaaggtctgtgagtaagttgggaggaaatggtggcaaactaccagtatgtttcaacaatcataatcacaaaaaggaactagtagggaagtgggtacattttcaaacttagagtgctaggatttctgagcagaaaaatatatccataagaatctttgaaagttgactcccatattctaaaaaatgagggataagagattcaaatcaaaattggttcacaaagttcactgaacggttcatggtctaaaaatacaccacactctcaccccatccaccacaatcagcgtcatcagttagggaaatctttcaacacggaaaggcaaaccatatctctttctgaattcatcaaaatgtactaaggaagatacaaaagagataaaagctgataacctaattagttgtaatttagcacatctcattccaccttttgatttagaagcctcagaagttagccagccacaagcaatcaaaaaatgattgaagaaaaatcagatatcaattgtctaaccccttattattagtctattgtaaattaggataataaaatatggggtgtgcctaaccattatttaatataaattttaaactgatttggggaattccgttttatccacttttcctctgtgctaacacctagtgcctgttttaatgacatacttgacatactatatagtacaaagttctacaaagattttccaaaatgttcacagtgattaagattataggtacttaacttttattctttttgtatgattgtatatgttgctttaaaagtaataaaatcatttaacttaaaaacaaaaaaaaatggtgaactgttcagctaatatttctaaacattatgccacaggtttaattatggaataactgcctacaactgatgtaaatttcattatcttagtactgtaacaggaggtcagaggccttgaaagggaccctctgaaatccccagggcaagtggaggctgagtacatatctactctcctgtatatacataccttgaaggaatcatggtgtgtgagagagctatttacaacttactttgtgtataatcagcagaaacaaaagatatgacaagtataaaggcctctctctctcccctcaggagaattcaacaagggagggccagtgggcattcacttcggtgtcaaaagggcttccagaaaacatattttctgtggggcagggaggaaatatggcaggcttcctacacacataaccacacacacacacacatacacacactctttgtttactgagatcacaaaaaaaaaaaaaaaaaaaaaaaatgttagggaccagacttctgaaaagaagacataaaaagctccaggttgtaaatgggagctaccgttgaaaatatttgaagatgaatggctgtgaaaaatgggtggcagaaaggggacaaaggaaaaaagagaaaagtcacagaaatgataacttgagagaagagtcatgttacgatgaaaagggctcgtagtcagggatgccccctgcagagccagggtccacttgaaatttccattttacttttaaatattaaacacgcaggtaggcatctgcctgatagacactatgaaagtcacagcctaaataaacaaactaacttccatgtgagctccagtctcctcagtcaagctggccccaagcccagatcagttctgaagtgtatgtgttttggtggcttcagtctggcagtgttgaagggacaaagaccttggaaaagaatgatatacaatgtaagtttaaaaaaaaaaaaagagggagagagataaacagaaataaagccccatcagagtgctcctcagagacatggctaggtacaagcactgccggattccaagccaaaaggaagacccaatagcactccagcctaatttcagtggttatacaatgccaagcggcaagaggaaaaatcactcagataacacaaagagttcaggaagaccatcaagtgaaatagatttgacaataagctcaccaggagtccctgtgagaaagagcagataaagaaataaacaaattatccaacactgtaaagatgaagatgcacgctaaacacactgctgcaaaataaatgaatacaaaagcagaaacacaggaaggtgagctacgtggcagagtatgcagttaaattatatctccatttttcagcctacaatttaactaggagacaaaattctgggcctaaactttctctaccatgggaccccagactaagactcagaaggaccaagaatatagaacctaagggcgaagaaggaacccactgctcactgatcagaaagcaactggtaaatcaaaacagagtcaaattggatgtggtggatcacacatgtaatcctagcacttagggaggtcaaggcaggagaccaggagttctagaccagcctgggcaacacagagagaaaagtaataatgaaagaaaaattagctgggtgtggtgacatgtgcctgtaatcctaggaggattacttaagcccaagagttcaaagttaaaaggagccgtgagtgtgccactgcactccaggctgggtgacagagtgaaaccctgtctcaaatatatacatacatacatacatacatactaacgacacagtatttattatccagcctgagtgacagagtgaaaccctgtttcaaataaataaatacaacacagtacttatccattttcaaggatggaatgaccagaaatacattcattgttatagagtcagataaggcagagttgtatcaataggaacatgataaggatgggagatattttataggagaagaactggataggacagatgccagtgcctgaaggagacacagatctcctctggagtcatctcagagcaatgaactataggatcagcataagataaaagaaaatggaaaagagtcaatcagtatgtgattctgttatgcaacaggttgaaagacacagaaggtgacggaggtggggggatgccagggtgcggggtggagcaggcacaatgtcctcacagccaccaggagctatttcactaaggttcactcttgctcttccctcaggagctgatcctctggggtgagctgccaaagaacagtgccctgggctctgtgataggagcaacctctgcaggtacaattacaggagatttttcacagccacaaacaacaacagaaataccttgtttttatactgtgaaatatgggataaaaggtaaaaatctctcttccctggtgacaccctgaggagcctaatggaccacgaataatgctaaaattacatagaatctttcttccagagtgctcaaagggctttacacgtaatatttattaattcccacatcagacaagtaaggaaggggagaaatttccattgtactccttttacttctaaatgagaaaactgagacctatcactatggtctccctctacatttgataaaaatggatagaagtgaaattaagacaaagttctctcaatgacttcgctagtgctttactcgaaaaacatcctactattggacagatttcacgtacttcctgcaattcttgctttacctgggttttagcattggagaaaatgagaatgaagtcacttgtaccagatccacggatgggtatgggttctttttttttttttttttttttttgaaacagagtctcattctgtcacccaggctggaacgcagtggtgcgatcttggctcactgaaagctgtgcctcctgggttcaagcgattcttctgcctcagcctcccgagtagctgggactacaagcacccaccaccacgcccagctaattttttgtatttttaatagagatggggtttcaccacgttagccaggatggtctcgatctcctgacctcatgatatgcccgcctcggcctcccacagtgctgggattacaggcatgagccactgtgcccagccattttttttttttttttttaaagatggagtctcactctgtcacccaggctggagtgcagtggcgcaatctcagctcactgcaacctctgcctcccgggttcaagtgattctcctgcctcattctcccgagtagctgggattacaggtgcctgccaccatgcctggctaatttttgtacttttagtagagatggggtttctccatgctggccaggctggtcttgaactcctgacctaaagtgatctgcccaccttggcctcccaaagtgctgggattacaggcgtgagccactgcacccggcgggttcttatatttaagaaaaaaaggtacagaattctattattctattggtttgcaatcattcttgtaatacattattttggaaattgaacaccacaggttgttgcttatgggcaaatacattgtcaactctgacaactgacattaaatgcaatttcaagtatgccacacccaggttaacttactttctatcctcaacactcaactccagctatcttaaagacaggtaatactgaaagagttctagctttgcaattagatctctgtttaaatctctaccgcaatatcttgtaaagttgctcagttacgtatctccgagccttgtttcctgcacctgtaaaatgaggatacttatatttattgtgcagggttggcaaggttgaatgagatgacacatgtaaagcacctaaggattcagtaggtacacagtatatctgtaaatggtactctgcccccagcccacaaaagcagcaccacagcataccaatccaatgaaggctgagaactttgagaccacgatggaagccgcataggggaaaggaaagcaagccacaagggtcaaaggaatattataagcaactggggaaactaaaaagagacagagtcacttggtctcacttagggaccaagggccaactcaatcatcttttagaaggcttcctagagtgatgctgtgtttggaatgaccgaaaagatcgctgtcagctcagagggacttagtgttaaagacttcactgggtgctgggcgtcgtggctcatgcctgtaattccagcactttggggggccaaggtgggtggattacctgaggtcaggaattcgacactagcctggccgacatggagaaactccgtctctactaaaaatacaaaaattagctgggcatggtggcgggcacctgtaatcccagctacttgggaggctgaggcaggagaatcgcttgaacctgggaggcagaggttgcagtgagccgagatctcaccactgcactccagcctgggcaacacagtaagacagtctcaaaaaaaaaaaaaaaaaaaaaagacttcactgggggatgagggggtgagagtggcaagaagcagcatatctgcccctcctgcaaccaaccgtttcacaattaaaatataaggtaattttctgagttctcttatgctagcagcctggcctataaattattaaaaagtaaagagtttccagagaacgtgcatgaataaaatctgaagaacccaaccctctgggggtgggcagcacactgacagacaagaccaatagtctcggtcagtgcccaaggcatgcttcttggccaaagattattgtgatcatcacctgagagcatgtctgaaactcatttgcatgccccacctgagacccactgtgacagaaactggaggtggagtccctcacctgtgtttacaagccctccacgtgatgctgatgagcattaaagtttgaggctccctagcccatgtaaactagaaaaccaaaaaggaaccataagacaaaagctctacagatcataacttagttttagaaaagatataacttaaaacaatggagagaaagaagaaggagcatacaccaaggcataaaattcttatctcccaacatctcactctgtaaagaaaagaaaggaagccaggaaaggaaaagcttacgagaaaaagccaaaatgagcaagcagcttgagcagtggtaaggccaactccacatctgctgcaaacattagaaagaaattatgtggggacagacattaactgtagcatttacatgaaaagcactttaaaatgatccaggtcaacttgaactcagccattgggtttgctccactcagcttctctacctatctttccgcggcaatcaagagtgaagatgtatttacctctaatgaggaaagagactgccttcaagtaatcaccatcaagctattgaatgctttattttggggggagggtgtggcatttttttagaaaagagtttacttaggaagaaaatacatccgtctgagttgctcttacttcatcagaggcacaaaaatggaacaaattgaaagggtttcctcccttgctaaacaacaccaaagggaaaaagggtgattgaaaaacttatgtgaaaaaagcagaatagtgaatttgaatgaaataggatagaagaatatgttgtggcatcagaaagggaaagagcaaatattagttcccaaaaattcaacttcacaaactactcattgaaccacctacattaaaccaattatgattttaaaaaaaagtttcagtagcatacacagtttaagagacaaatacaacaggcatttactactagagtaaatgcacagtggttggctagagatgcaaattactctggactagcaccttggcccatttgacatgagttagacttactatgaagactgagcctgaaggaaggccacagatggtaccaacagaccagaggaattccggctgctctaaacaggggagccaggggagcctttaccttctgccaaggctcataatgtagcatgtcgaagatcaatgaatcaacacggttttctttgcatgcaaagcttgaacataggtaatgttaaaagaagaaaggaaatgagaaagcagattcagtcctgctgttccatacaggaaaaattttcccaagtcaaacataagtcatactgtatactacacaatcccccctccaagcctgctgaggaccccagactaaaaagagaaaaatgtgcaaacgcatacaaagttgatttctaagggatacccccccacccccatcccaaatgcatggatctcaactggggtgagaactaggggagatgaaaagctgtagtagtctgtatcagacaggtaaaaagtgaatgtaaacccgtcctaccagtaacatctttgttactaaggttctcaggaagtggagagaagataaagtcaaagggagttatattttccttgggaatcttatgaaaatattttttccccaaactgaacatactttacccctgaaacctagtagctttagaagctaagaagagaagcttagtggacaacagaatgctttataaatggtaaaatacatgagagtttcttttttgcttttcttttggtattagttgcctcacaaaaagacagagctacttacgtaattgacttacccaatggtaagtaatacttaaaataataccattttctttttctttatttttatttttgagacagggtcttgctctgtcacccagactgggatgcagtgatgtgcatttgtgactcgctgcaaccttaaactcctagactttcctttcagtttacttctgaatatctctagaacatgactccaactaaagcaaccttctagaagggggaaaatacccacgtgccctgcaatttagctgagaagtgattctttttagctaaatttttttctttttctttcttttttttttttttttttgataaaaatgggggtcttgctaagttacccaggctggtcttgaactcctggcctcaagtgatcctcctgctgcggcctcccaaagtactgggattacaggcatgagccacatcatgtggccgcattttctctcttacacgcattctcgttaagtgacgtgaagctcttctcaagtctcatctgtcacgtacctctgtgtgaacagggctcccaaatccctaatccttacctctcatgtgaatttcagtcctgcattttcaaactctcactagatttttctaagtgtccagttaacatctcgagctaaacaagcaaataggttcactggtctcctttctttactacagctttccctggatttttctatatttttcaatgttattaccataagcccattaacaaagactcagaaccatacatcattattaaaaggcttctccttatttcctgaacccagtcagttctgatagcctgtccattctgccctttcaatcccctcagctgtcccccacacactttccagaataattctaacaagtacatgctcagacctctgcaataaccctttagcaataatcctgactttatcattccatacttgccaactagtgctatacaccacccctccaattgtcgaacacattctcctagatcatgtttatagctccccaccaattaccaattacagttctttccaggccctctacaatctagctctaacctgcctttccagctttatcttctcctccttcttcatgaaaaatgcttgatagacactctaattagaatattttatgtctcttgcatactgatttggactttcctaacctgaaatagttctcatgctgctctttttggaataccctcgcctgtattctccctttgaaaatgtccctatttcctgatgccacttcttccatgaaatttcctgatacctttggatgaaagggatctcatcgtcccaagtgctctatgttccttagggctctaagcaccacatgaccttgaaccttaaaaacatgtttttctctccttaggatcaagaactaacttatttctctttgtatttcccaatagcacttgccatactgctttacacatagcagatagtcaacaaatacatactgaataataaataaatatcttaaaattcataagggcaccagtgacacaatgttacaaatagagtgattttaactatttcattattccagcagatcctcaacaaatacccgtaaggcaagtagaggccaataattcctgttttatagaaactcaagatgcaaaaaggttattatttatgcacagagcattttttcaagtataatttagcctattaaggttcagtaactaactcaatgtcaccctgttgatctgtggtatatttctgctgaaatgattcttctcctcttattggactttcctttcagcttacttctgaatatctctagaacatgactccaactaagcaaccttctagaaagggggaaatacccatctgccctgcaatataaattaaagagtgtgccgtgcacggtggctcatgcctgtaatcccagcactttgggaggctgaggcgggtggatcacgaggtcaggatttcgagaccagcctagctaatatggtgaaaccctgtctctactacactacaaaaattagctgggcgtggtggcacgtgcccgtagtcccagctactcaggaggctgaggcaggagaatcgcttgaaccaggtagtgagccgagattgcgccactgaactccaacctaggtgacagagcgagactccacctcaaaatatacaaaaataaaattaattaattaattaaagaggtcgttccttgcccaacaagttgtcaacatatgctgaaatctaaagtatacgatgtggcagggcacggtggctcacgcctgtaattctagcactttgggaggctgaggcaggtggactgcttgaggccaggagatcaagaccagcctggccaacatagcaaaaccccatctctactaaaatattttaaaaggctgggtatggtggcacatgcctgtaatcccagctagttgggaggctaagaggcacaagaattgcttaaacctgggagatggaggtggcagtgagccgagattgccactgcactccagcctaagcaacaagtgagactcgatttccaaaaaaaaaaaaaaagtatagaatgataaaaatatatactggtatatataacctcttagtttaaaatttactaggcttcaggagtaggagctggtatgagaagctcctttaataagttctttaaaattaagtattgattgccacgtacctggaaagaaagtcagtcatcagcccattacattgccctgagataggaacacatttctaagaaactgtaaaagcagtttacagcaaactagggataaattttcatcccaaattagtttctacttagtttcaagtccagggtaggcaaacaagcctgtgggccaaatgctatcctgctgcctacttttgtaaataaagttttattgaaatagagccctgcctattcctttacatacacaggggcttggtcctacaaaaacttcaataattgctacagaaaccatacatctacctatttaccatctagccctgcacagaacagatttgccaatctctctcttaagctgtgcaaaattatgctgccttccctagcagtatcacatctgtcttcacctttaggaaataagcatacaagggcaagcaaggatgttcatatttaagcactactgtttattaaaaaaaaaaaatccacaaaccaagaactcattaaataaactatgatacaatggcaagctaagaatccattaaaagtcatgatgagggccgggcgcggtggctcacgcctgtaatcccagcactttgggaagctgaggcgggaggatcacctgaggtcaggagttagagatcagcctgaccaacatggagaaaccccatctctactaaaagtacaaaaaaattagctgggcgtggtggcgcatgcctgtaatcccagatactcgggaggctgaggcaggagaatcgcttgaacccggggaaacagaggttgcggtgagccaagatggcgccaccgcactccagcctgggcaacaagagcaaaactccatctcaaaaaaaaaagccatgatgaatacctatatttacggacatggaaagatacttaggataacaatgcattttttaaaagtcacatatacatgtaacatcatccctttatgaaactaccacctattcatacattggtaggtacttgtaaatgaagaaagacgactaaaaatacattaacagttccttggtgatagcccttcaggcagttttctctctttgaggttttcttaatcagatctgccctatgaacacatatccttttgtacagaagttgtatttaaaagttttaaaactattaaaaattaatatcagtatgcaaactttagattctacattttataaagcactgggttttccagaaagctaagatggtatttttaagttacttttggtttgggtagtgattttgttgttgctgttctgtttttgtttttgtttttgttttgtcctttccctttgttttaaaaacagaaaggctataaggcttaccagtaacctgcacatctacaaactgtcatccccactatatgtggcaacctaaataatgcaacaaaaaagtcccttatagaagcatgcatgggttaggaggaggaagacaggccaacagaatagtcccttgatggaaatgtattaattcaatcagtgccttgcttctgggttaccataaaaaggttcataaagtacccaaaagccacataagattttagaattatgctgctcagtgactgattctcagtgaagagtaagaaagaagagatttctctccaccctcattttcttctgcaaaagtaagacttctgcaagagtgacacaagtattttttaaactagtaattgaaaaggccaagtatgtacatgatgcaagtataaagaacactgtggcactgttgataaacagataccaagtgcaaactgcataagactagcaatctacaatagtaacagacagaagaagaaattggtctaactaaccctctctgtgccagaattcacaggcatcatttacttctaagccccattttataaatgaagcaactaagattcaaagaggttatataacttttacaaagtcacataggaaagagatcagttcaaatgcaggtaaatctagctaaaaagtctggactcttctcactatattcatgaaagagacatatttctaataaagagctacataaattcccaatgtaaatttatctggtgagaaaacctgtaatttctggtttataaagatattacagaattatcatggcagttaatttgttttacaagcaatttatttaaaatagtgattttgacattattttcccagttaagttgatccactttatcttctccatccttatgtttacacatatatgcctgtatgatatgtatatgtctttaatagatatgctataatgtgatatacagcacccaaactttaaccttcaaaatgaagtagagtctgtagacacagacttcagttagacataaaactgtgacttagttttttcagactcgttccatagtaaaattacttcattgctatggatgaaacaaaatttataccctgaaaattaacatttacaatgaggccaaacatggttgctcatgcctataatcccagcgctttgggaagccgagggaggaggactgcttgaggtcttgatagcaagaccccatatctacaaaaaattagccaggcttggtgtagcacaactatagtcccagctattctggaggctgaggatcacgtgagcccaggaattggaggctgcagtgagctatgatcacaccactgcactccatcccaagcaacaaagcaacaccctgtctgtgctgcgcaagctggactcaaaactcctcggctcaagcaatcctcctgactcagcctcccaagcagctgggactataggtgcgtgccagcaacctggcttgtaattttttttgcggtggtatttaccccacagtctttcataagcttttaaaattatactgattagcagtcaggtgcagtggctcatgcctgtaatcccagccctttgggaggctgatgcagatggatcacctgaagtccagagttcgaaaccagcctggctaacatggtgaaaccccatccctgctaaaaatacaaaagaaaaaaattaactgagcgtggtggcacacacctgtaatcgcggttatttgggaggctgagacatgagactttcttgaacctgagatcgggcccctgcactctagccagactctgtctcaagaataaataaataaataataaataaaattatactgattagcttttcctgtgaattccacataataacatcgccaagcacaagataaacaaaaccttcaagtcccagatggggaaactgaagagttgcactaggccccattttctggggtgtggaggtattaggctaaggctttctcatcaagtattccagggatccctaggagaggcttaaaagatgggactgtggctctatctcttttcatctagaacaactctgatttttatcagttctacatactgacttcctcataaaatttaatttgaaaggaaataaaaccagtggtttctacaactaactttcttttttctttttaaatagctagcttaaatgatatatgaagaatgcagcaagggggaaagcaagggatttggaatcaactttgctggattacacatgttaggccttgatttcttcatctgtaaaatgaaaatatgggtaccttccatgaatgcttttgtaagcataaataagatatcatgactagcatccctagcacactatgtgtgctaaaaggtagcaataaagttattagttaacaattttcatttttttatgcttactaacaagccaaagtaaacactaagtcaaatatttattttagatcttaagatgcagtatgttcaaactttggcaggctaaaagaagttagatgttaagcaaaatagcaatactaaataaagaccatctacaggcaggcgtggtggctcacacctgtaatcccagcactttggaaggctgaggggggcagatcgttttaggccaggagttcaagactagcctggccaacaaggtgaaaccccgtctctactgaaaatacaaaaattagccaggcgtggtggcaggcacctgtaatccaagctactcagcaggctgaggcaggagaatcacttgaacccgggaggcggaggctgcagtgagccaagatcatgccattgcactccagcctgggtgacagaacgagactctccaaaaaaaaaaaaaaaaaaagaccaaccacaataatattaatgtacttcacatgggaacacaattattttttatgaaaacataatcctgggctaaaaaacaataaaaagaagcacattattttgctcaacaaatagttcctaagtccttaactaccctttaggcattctgcaagattctaaatgaagataaagtattgcccagatacatgtatgttgactgctgctgttttgtttaattctacagaggtgtaaacactcgaagctttagtgtggtcttagttccatgattataagtagattttcacaaaaccagggacagacgctggagtctaacttgcaaaatcaagtttcaagatccactatcaaatgctaatgactataaggcaggaagctttaattcaagcaaatgattagaaaagattatacaaaagtaaacaggatccaacagaatcggccaactttacttgtaaactacctgtaccaaaactggtaacacagaaatgatagcatcactctgacatccacaaagatcaacctaatgaaaattttgcagagtggtaaaaatgtagactaataaataacgccagagtttctttacttaaaaaaaaaaaaaaaaaagacatctgctgatggcctaatatcgcctttcctagagataaatgaagaacctaaaacattttatttaaacttattcccctaccatcctacactactatttccaaaaattcaagcttcccaagggataaaaactggagaataagccacagagcaggtcaaaggaggatgacctaaggtttattaagtatctactatgtactggaacttcaagtgtgttgtctcatttcattttcctgacaatctgtaagctaaatgtccttttccccattttaaaagcaaagaaaataaaggtcagggataaagtcacttatccaaagtcacaaagctaacatgtagcagcattagaatctgaaacaacacccattttttcactattccacgaagtttccaaagccaaacaagtgtgcctggcacaatgggaacaggaaaacactaaaagaacaagtgatgatattttttaagaaaattttacttttatgcggagaagattcctaaatcagctgaaattttcttattagagagatgtgatactggagtaattccactcttcccctcttggattatgaaaggaaacttttaataaatcaaattggaaagggctgaacacaactacaacatccttttcacagtttaaaaaaagtgcttctatcactaggaaaagaaatataacttcagataatctaaatgttaattgacagatttttctcctaaatttggcaacattaactactttttctagtatttaaataaaataattaactttaaaattggctgttaagtaaaagaaataaaaatccagcacagagcaatattctccggaaaaatcacattttaaaatgtacaactaaaaaacaaatcactaaaaaaactatcatcatgttactagaccaaatagaacaaaaagaaataattattgaagtgggtattctctagaatataagaaaaaaatatctaatgaattcacctaaaatttgaagtgcccagcccataaacacagcttgattttcctatggagctgatcgcttattggtgtaagacttcctataaataatgtcaatatatatgtttaagaagaacaagccatcatacaaacaccattagtcagattaaactcaggggtctatcttgacaaaatcattgttttataagatatatataacatgtacttaaaactctataaatagggcacacgggtccactcatagtttacttttctgtgctatattcttgagttgaatttttgttacatgactttctgactgataatgtatcaatggaaaagtaacttagcagctctccaagttttttcttataactatttggcagttattaaaatgtgcacacactcacacacacatacaagtatatatgtattattaaggaaaagaaaaataacatctgaacaggaacatgaaaacaaagaaagaattaaggtttgaaattgaagagaaatgcagtccaaaagtaaaattcaaactattattaatatatcctttcttaggtcatcttaggataatacatatttctcctatacattgggggaaaaaatcagacacatgaatattttataaaggcacactgcattatcagaaagctgttccacacatccacactttaatctgttataaattaacttgagtcagttcaaatgttatatgtaatgcacacgattacaactgaagtcaaatcatacacaccctcagtaactgtaagcctaaaacaactccaacagtgaatgagacggctagagttttccctaaggaaggataggggttgggggcaatctgcaaaatggatataactgagacaaatgcaaagactgaaaatatcctaaaaacctgaagatgctcgtgtggtttcacaacaaagtccctttataagatccacagcccaaatgactgcatctttcaactgctccatttccagaactcctgattttaaatcacactgaaaacctttggctgcaattgaattagcatggttggatttagcccttctaaatgccaaaaaggaaaaaaaaaaaaaaagtaccattctaaagtttgttttgttttaaactcggatcttctgcattccaaaattgtatccctctgactaatataaaccgttattacagagaaatggtttttttttttaaaaaaaaaaaaaaaagccagtgaaaaagaatgagggagtagtaatggtaacatacagtaccatgagctgcagcggcctcccagccagtggtgcaaggttaacagatcagtcctggccttcgggcagacagcagaacacagccttggggaaggggggacagggacggaggccaggggagggggcccgctctcaggcagtttacacaagaaggcagctcagctcctttctggcgcactcctcctctctatctcccaacctctttgcgtgtgtcttgtcatattttcttcagctgttaattgtccagactccaagactttaaacagccacagtttaggaaaaagcgaaacccttctaagtgaccatcacagcaaatcagcttcatgctagtgggtaaaattttccaagggaagtgttcttctgatagttcctgagtctctaagtcacccccacccccacccccaccggccgccacacacactcccctggagggctaaatgcactgtggcaataaaacattcatgcgacttggaattttaacacaatgccatttccctagtttaacctgaaaggaatgcactagtcacaacagactacatcatcctgccattaaaccctgccaaggaaccgcttttttggccgcgctgggccagctttgacgggaaaggagtacacagacccacacactgagcacagaggggccacctctgcttcctcagccttatccagcaacaccctgctcttgaacatgacccctgaccccttgcattgtgaccagcttgtgaggcatgtgtcaccctggaatttctgcagagccacacactgcgcaggccatttgctgctccctctcaacaggctcttgggcagacgccaaaggttctttcttattattactgctactattgaaagtcttctgtttaaatgtagggatgctttttcctcgagttgtatgatagtgtggcttgggtttttttttccctcctttgtttgttttggactttttaaaaaacaaactttacatttgcattgataattatgttattattaatgacaaaatgattcagtatggggactacttatcaaaggtgccagttctttcacatttaagtgacattcaatttagatttacaaaacacccagaaacaattcctatttctccagagaagttgagagaaaaattcaaagggattgaatcctaaaacacctacacttaaccatttttatttacatgctattattacaaaacaaacaagcaacaatattagatcaaaaaactggatttactgacttattgcttgtgcagagagttctgccttccaagcaacataactgacaagcaactattttaaaaagtatgtataccaaatgaaaaattaaaatcatactaaatgtttacaaatgtttttataattttaaaattgttctcatgtagccctttataaccaatcacaacagtactaatttttgcaagttaacagaggtcatagttttgcaccccaaaatacccctttcttcttctaccactgattctcctaccactgaaggatgtcttccagattgtctttttctgatcattcatcttattaactatcttcatatgatgcacattcactttcaatcttgtccaattgttttattattcctcttctctactgtagtcataggcaattctaaaaagcacaaagtcccctctttttgccctgaccttgagctacagccaggtgagctgtgattatccctacagaaggcagaaggtgttccagctttaatctcctggagtgaggccatgtcccctttcagtaacaaatgaagaacatcttacttcatctaagagaataccctaaaatacaaaatgatgatctcaaagcaggttaacatgcacatataaaataaaaccaaattgtcttctttagagtaatttttgtctccttagtagctggaattagtcttaagccctagttaaaagacttttttctttttctttcctttaaacagacattatcatgccttgaaaagtcattctaatcccttcaccttagccaagccatgctaattcatgagaggacagcaattaatttttaaaaaaaaggaattatacttgactggggggaggggagaatcaatccaactcagaagcaaaggttaccaaaacctatgtgaaacacttccatttcaaattgcaaatgctgaaatcaaattgtcagtttaatctatataaaatacagcaagaaggctgggcgcggaggctcacgcctgtaatcccagcactttgggaggccgagacgggcggatcacgaggtcaggagatcgagaccatcctggctaacacggtgaaaccccgtctctactaaaaatacaaaaaattagccgggcgtgatggtgggcgcctgtagtcccagctaatcgggaggctgaggcaggagaatggtgtgaatccgggaggcggagcttgcagtgagctgagatcgcgccactgcactccagcctgggcaacagagcaagactccgcccccccgccaaaaaaaaacaacagcaatagacatttgatttttttcaagtaatctgatttattatcaatgtgcatattcaaattccaattttgatgttactagtgtgaagttactagagtaaaacccagtaaaattgaaggaagaatcaagtgatgccgtgagattaaaattacagaggttaatttctattttagtccaaacagatacacttttcttcttatatcaagttaatcaacacagtgacaccaaagtatcttggaccaatattcaaaggatgaaccggggcctatgaaaagaggtctgtgaagttgcacctgcagtacatgtaaccctctccatggtaatatatctcctctgaagacctctggaactctgggatacatcactaaaagaaggataagcaatctcattttagttctaaacaagttgccaagtaattattactattattattatttttgagatggagtctcactctgttgcccgggctggagtgcagtggcacggtttcagttcactgcaacctccacctcccaggttcaagcaattctcctgcctcagcctcctgagtagctgggactacaagcatgtgctaccacacccggctaatttttacatttttaggagagacacggtttcactatgttggccaggctagtctggaatccctgacctcaggtgctctgcccaccttagcctcccaaagtgctaggattacaggtgtgagccaccacgccgggccaaagtaattttataatctaagtattcactactatggtatagcgatgcatcacatattaggaaatcagagcatgctacaaataccacgatgaaaactattttctatgaaattgtaccagtacaaataagtggaatcagaacaatacagaacctgctgaagaaaaaatgtcgtatcagtaagttcactgaaattcaaaaaggtgcccagagttttgtagaaatgttaatttattttggtgggtacaatgtgagtagatcaaatctgtgataaccagccgtgatttccattttccttgagccaaaagaaaactttactgtgttaaatggcatttagaaataagagttttaaagttctgtaagctacgttttaatttctagaaagcaaaataggtgaaagttttctcatgaacttctattaaaaacaggacatgcatgtgcaaacaggcatacgttaatttattctgctctgcagggattcatttggagtcgagagattggctaaatcaaccccctcctcaacacacacatacaacatgcacatgcaagcaaaggcagttaacagacaccaaccctgagtgagggaaaactcactcagagatgagaaaggacaagatgtgtatggacaaaagagagaaggaaggaaaagcaaagagatggtgtgggaggaaaaccagattgagacaaaagcaagccacaggaagggcggggtgagagagaaaaagaaataagaatgagatggggaggagcaaaatggaaaaaagcagagaaggagtcagtagggaaagggagagaaaaagaaaaggaagaccgaaggaaaaaagggattgctggcagagaggaggagctggagccccacaacaaaacagtggatcaggcagctggcctgagatgctgattcagcgctttaacaaatcaatgccactagaaaagcacaatgtgagccctcactgggtagatgtcaggggactcagaaaatgcattctcaagtatttcacattaagagggaataatgtgttaatttataacgcttcaccctatacacttggattatctatctgtgtcagcgatttgacttcttaaatttatcaaaaacgcacgcaaagggaggcagcttcggcttcaccgctgggaaatggaggtttagggaaagcctgtcagccagtcctaggtagttctgctgttctttccgctttcctatttgggctgaagtgttggtgggggtggcagcaaggagtgagcaagccactgaaggggagatgaagtggggaggggaactcctggtccagttactaaagcaaccaaagaaaaggctttctcggcctgtggttgattgcattaggtaccatccgtcaaaagtgacacagaagagaaggaataacttgaatcagcaacccacgctgccatcgtcagaatttactttatggaaacttacttaagtctctcagcacacccagtggaagagagcctgctgacaactggattttaattaaacagtacacttgcaatgccaccacagttccacagagcttatcaaaataggaagggaagagagagttaagcgaattttgtttggttagttttgagacatggaggagagatgttaaagaactcagatgccagcccagcattcaggagcctcattagagggactatttctttctcaagaaaaacctattttattaaacatcaaattcttggaattgtttcctaattattccttaataaaatttagttaacttttaatataatgattgcacagtttctaacctgtgggagagacagggaaagactacgttagtaagttttgttgccaaaattaaagtatgatcagacttaaattttcaaagtttaagcattgtcaacatacaaaggcaagtgtgttaaaattttggaataaatagaagagagtaggtttcaagaaagtgttttaattaagattatgtcttcaaagatatgaaggggaaaagtggttataggtataaaggaaaaacaaggcccaatcacgaataacttctaagattgcccagactacacacagtattctaaactggaggcattcttatttgctacatgtacaactgcaacagaaacagacattctcttattttcaagacattcatatgtaaatgaatgctgatgaatggaaatgagatgctaaacatgatgggcaacgttcaacatttaaaaaaaaaaaaagttacttcacttgctgaagcttgaatctcttcccctcctacacctgggcacaaaaagaaatgaatgacaatgatggaccttccaccagtttctattggttaaacaacaccttacagagatactcaagacagaaaacaaacattctttcagtcttatgctttgcatctttcctatgacatgtatcacacagagtccattgaaaataaatattagagattgaaattataagtaaatagccagaaatattacagtggcattgagccaaagggctaaaatatccaaaacagtgtaattatttaatgaatgttttctttctttcaaatgagataattaataaggaatttcctggttcatgaccacagagtacactattttcccttttcataaaatcttaggagaccgaacatatattctgggcagtgtgtttgcagtgggaattatatatatgcatgtatgcttttcaagggtctctatttatgccctcagagtaggatttgttctatccccagtttttgcatgaattaccattcctgtctgtcccatccaagccacccccacataaactatctattcttatcattatggtaccattaatcccattctcccctccccctcccaactcacctaaggggttaaaagacttcagtacatttgtgacttgtcagtgacatataatacccaggtccttcatgcaatcaacttttacttgacatgtatttgctcatcacaggacccacattactactgggaaaatgaagaaaaacctaaattaacacttgacattcaatatggtcaagtccttaattggctgggcttcctgagaaagcaattttctattccccaaactgttcgcgtgtcatgtgtagagtgcagctcttggccatcactgctgtccctcgctccctctaatgagagcagatgaattagtgctacgtgacacgatttgagcagggcttcctcctcctcccctccccccagtctttctcctataccagtgacagctgtgtggcaaggggaagaaagaaagagaaacgcaagagcaaagaatcctgtaaaggatgatcatttttttaaatgaaccttaaatgtctcgttgaaactacagaacaacagggtcacttaattgtggaggtggggaagggggggcggttgttacaaagatcaggggaattatctggctgtggttgatttgggttgtattaacttccagcacgtttcttccattcctcgctagttgcagtattagactgcactgctctaattaaaacggagtttacatccacttaaaaagtttttgaaaggtctggagaatgggtcaactaggaaaaaaagaacagcatgaagtgattattgttcgaagataaacatacctctaaactagagaaagtcctttcaacaatcacttaggtcaggaagaacctacagcacaaaactatagtgatactttgttttcaaatattattccatgtctgagcttaatgcaaactattctttcctaactcattttgttttgtttccattgattgttgaattactgaaatgaaaaattacttgatcactgatttcattctattattctggagagaaggaatatattctactttaaatgtgcttgtctcactcagtaagaaacaatgaatacatgcatgaaaggaaggcaggacagagtctgctttattcaaaaatactaaaaggcaaattaaaggtatttctctgagtcttcacttactcgttttgagaccaaagaagtagtaattttaaatccctaatcgctcacccaatctgattaggacaaaacagaactacaggatagaagagcatgtggcaaatcatttaggaaagtaattagtacaaaatacatggataagtgaaaataattagtgaaagtcacaaataccttagcactttggatcattactcagttttatttaggtgagaaccaagacaaaaatgttacctgtgtacaaaaaattatatcaagactgcactgtggtgtcacaaaatcagtttacacacgcaaaacacaaaactatgtcaagtatagctcccccgcttcaagtagcatgatcattaattgttcttctataattctgaatataatttaagcagtaataaatactgaatataatttcagtaagtaaattgtgagtagatttaaagatataaaaagatggtgacatccacttttacactatgtgtaaagttataacctaaagccaaaaatgctatttccacatttttatatttgtgggaaataatgggaatggaaatgaagctttataagattttttccaaaataaagcaattcataacatcttagagtattattgcactaacagaagacaaaatgtaaataaaactgttttttaacaccttgaattttcaaacttgttggaacatgattagtttcagacaactgaaacactaaaagatgagtataattttagaagtattttcgtggaagcaaaacaacacaacggacacacacactgcacagattatctcttctgaggccaaagcactgatatttcactatcattaagatcccttttgaaaatacacttgagacagcttgtaaatgggcattttatcaggtgtttaaaagaaataaatagataatttggtattctggaaaagtagctcagtctaatacatccagttaactgctacagtagcattatcatcactgagcaacaaagggcagtgtattctgccaatagctttagggtgacctttgcaatgctgactagtccgtcaaattccatctctgagatgcaaggcatagacagggatggtttattaactgaggtaggaactaaagactaggaggctccaaaagggtaggcgtttcacattcaggaaatggggaattcctttccctaagaagagaagcagtgtaccgtaagatcaggctgagcaggcccatcgtcctccccatggagcattccatggtgggaaattgtcatgtactaggacagcattagcaattttacagttttacatgttccttttctccccagctacacttttttttaaggactgcaatggaaacccaaatggaaatgggtaaaatgggatcaatgtcttgagccctaggaataaagctgcaaagggatacttacatagtcatagacctttcaacaaattgtgaccaatactacttttatttggaggtagtttccaaccatcaccaacaggataaatctacagaactcaagggggcagaaacaacgggtaagaaaaatgactgtactgaactgggaaatttttcaaggataacctgtagaaaaccagcctaggaaaaggcactttttttttttttttttttttttaagaaagttaactgtgactatggcaaagtgacatgcttaaacttgatattctcttagggatgtgcaggctttgaagctcataataaacttgaaatggctctgtggaatgttaaggcttaatgtagatggttggtgccactgtcatgcctatacaaaagtatgtcaacttagaaataactgcactaacagctccagggtatttagaatggaaggctttcccccgccctttttttttattaagaattttactttgaaccataagaagctgcattaagtttccaacctagttagtgcagctaaaattaaaatacttactcaattttggctgggcgtggtgccctcatgcttctaatcccagcactttgggaggctgaggtgggcagatcgcttgagctcaggagttcaagcccagcctgggcaatatggcaaaaccctatctctacaaaaaatacaaaaatcacctaggcatggtggcgtgtatctatattccaggtactccagagactgaggtaagaggactgcttgcgcctgggcgggagaggtggatgctggccatgagcccagatctcaccactgtgctccagcctgggccacagaaccacaccttgtctcccctcaaccaccaaaatgatactaatttcggtttactgtagaaaggcaaaatgtctgccacccacttcgtctgtgttacctttacattacaccattctcaaaaagtttaaacacggcagaggagagaaatgaatgctttgaaatagcctagcatatgtaacaataaaactatctagcaaacacaaagcacaaatgttattttataaaaattaacagcatctaaaggggtatattcttttatcctccattattcgctacctcttttacttcagtgcttccctccccttatattaaagatactttatctaattcccagttgaaaggtttctgaaagcgttaagtcacagctgtgttgatgctgaacttcttgaacatggcataccagcatcattctgacacatttatagatgtttccttacaagctgcaccagcacttgatttgaaatatctgacttactctaacacaaactgttaatctctggtcttttctccagttgagttcttctctgaagttttggaagcaaaccaacaacttgttatgtttaaaacacaaatggctcccttctgattggtttctgacactgttcagtgatgctgttaaacaagaccctagaaagagcctagatatacctaggccccatttgcagatcattttaacaggatgttcttgtttccttttcccacgaaaatcaataacaggatgaccttcaatttgaaattcaaaccaattaattacctgttctgttgaaaatgctgataactgatttgcctggagaatttcaattatgaatagataatttcttttaaagagacccttcaaaaaatatagacaggcattttaaacctcatcttatacaatataaataatgttttcttgaagcaggtataaaatattggccttgcatgaattagtagggggaagttttcccccttgtggtccatctcctccttgtgacatcataatcaattgcttggtaaattatagcaatcccacaaagattcagggccaagaatctaccgctttaaggtgagacgaaaagctttttatagttgaattcggcttttcatctacatcaattacttacacaaatcatgggattattttcagaattcagaaatcttttattattttaaaatccttatgcttctacctttatttaaattatttgactatttttttgttttgcccacacaggtgatttttctttaaatgtgggtcataaggagaaaagctatacatcaaaactatcagcaccagaaatatatttactaaactttttttctaatcacaggggaaaaaatgaagaatttggttgatcccagtggggaattcccaagatgaatgatcacatgcaatgaaactattatcttcatccattaaaatattatctaaaacagaggtttctatctggcagccagagggctgaatgtagcctgcagatgagttttgtttagaccacacagtttttaaaatatttgaataggttgccaagatttcaaaatcaggagatttcacataaaaatctggatttttggctcatcattataaagcagcagcagtggatctggcaaactgggcgtgcattcccacctggtaacaatcggctggaaccaaggagcagctacctcactgtggttgagacatgagctttctggtccaccacagttcccactagactcactctacttgttttaatttttgttacctccacatggcccttttagacaactactactccttaaaatgtcatactactctagagtttctgggaaaaaaagaagagggtgttctcagaacagagatttaaaaatacatatttcacaagtttacagaatataagacaatgggaagcaagtttcatttcaatgaaacattcgtgcaaaccaaaggaaactcattttcataattaaatgttttttaaaatagtaaatccagaactgatgacccagccttacagagtggttcaacaatctttacattggttttcaatcagccacctatttctctgaagcccaaaatagatgctcatgtcaaagcattactcagattttgttccttcacatgttaacacttccacacttcctttctagagctatcatgtacttaagtgaaaatgtactgtaatatgaaaataggatatgtcttcaaggtatattttaaaagtcaacatttaagatgcatgactattatcacagcaaatattcatctttactgactccacatgtatgccaccatctgacatttatacttacattaaatagacattattatgggttcaaatgacccaaaaagtcatggcatatttctttacaaatgattattacctaaaagcagatgtctatgacacagtcaccatgcacttctttatatctactttttttttacatgaaagcaattgcaaggagaatatcttttacatttcattattcccaatcaatcacaacgacacagcatttctacctattaatggattttaaaaaccaattaaaaataccctatttagcagagggaagcaacggccttctcatttcatccaactatattaaaaacaggctatctctgacgtattactacagtacagaaatgcttacgtatcatgcaaactgtagtacgtaggctatgaccagtcatatgccaactaatttggatcaactatactatagtgtttttacattatgtttcatcattgcaccacatgcttgaaagattagtttttaaggtgtttccttccgaaaggaagcatttttcttccatttttacctaaagaatgtaatccctgaacatatgccaaatttacttcacaatcggactttaatccccaaattctcttgattcttagcaacttgcacaactttaagtaaacagttcacaaaatcataatgatcatactgtagcattccttaactcctaggtgaatagaaaaaaagaaaataccgtaaacatgaactccataaaggcagtcttaggtaggcctgaatgacagtgtatttcttatgggaaacatttttccttaatttccattatgattgaaatgtgagcaattagaaatagacacctggaactcagttgttaatttatctctccgcacccctttcacacttttcttcaaaccatttcttacgatgcatctgaaagatatgatcttataggatgacctgcatataaagggcactgaaccagtgttcacattactttctttaaaatgccttgttgtaatccaagactaaacttactttctttcttttttaagtatatagctttagggaaaaaaaatggaaatttctcaactaattactgagtaaaatcatttaaaaaacaaaaattaaaacaaacattctaaggaaagtatatacttcattacattcatgttaatttgccttttataccatcttagaaagagaattttatgaaatacacaattccctaccatgatgtgatgaccaaagctttaagctggtctcctcaggttcacatcatggcagctgactgcaaatatgtaaagcagttctggaagactcacaattcacaaatttttgtttctacttaattgttttaagatgaaaaataaagtgtgagataatggatgttttagttaatctgtgttttatggagagaaaagtattactgtcacttaactccttctattaatcactctattaagcctactttgagaaaagagtatctcaaagtaggcttatattgaagctcattttcggcattctgcagttgtaaaaaaaatttaaaagatcaaaagtacaggactgctggcacatacaggaacagtgattatcagaatactcagaaggtaagcagcagttggtttattaagaaattatttaaaataactgtttacacaagttaaaacaaccaacttctcacttttactaaaaggatgttttcaatataatgaacacccaagcttttctggtcatgagaaaacctggaatatattatacacgcatgaatgtggcccgggatgcaggatatgggatgtgcttcctatcaacagattaacacttcattttcattactctaatctcaccacaggctgtgaacactctctttttcttatttgaacaacaatggtacatgaaaaaccaggctgacaggcaggcagggttcattaagtgcacaaggcccttattcccataacacatctcacctgtatgaggccagctttccggctgcccggctggctactgaaacaagctctcccagatgttggagtttgaattcttcttatcccttcctacttacattataatagatgacaaaaataaagtaaaaatgaaaaaactcctctccacaatgaagagtatttagtcatgataggactggtaacatattttaagctccattcagtcccatgattactttccaaagttgtccaagagaacaaacaaaagttgctagaaagggaaataatgagacatctgaaatttgagtcagagagactcatcctggtgtctctatcctagcgcaattctaatttatctgaagtaagctgtagtctcccacttgctgaaaatggcagttcacaaaataagaaaccatcatgctattttccaatgaatgacactgagtttcaccaaaaagctatagtcaagaaaggaaaaaggctatatagatagcatagtataaggaataattacaacaagattcttaggatggagaatgcctctttggggaaagccacccacaggctcactgcctctgaggaagtcattagcaaatcctcaacatacatagaattaagtcacctaattgtcaccagccaaccaatggagcaggcatacactttctgcatgtctacgcattacatataaatgcactaccataatgtggcaatatgggatttttagtactttcaagacagtaagtccttccacaaagtttacagccagactttggttttggttctttctggtactctaatatttatacctaaaaaagaaagaataaaagaaaagcaatattaaacagcagctaactcgctgactccaagttaggttctggcatgaggtcaacaatgagaatgtttgcaggcattctcactcagggacactctcatgaatatgctcagtgtataattactccccatatcttgccggtgacatcccagccatgtccactgacctccagcactggcagagggcgcagtagtgggcagctttcttaatctatgcctgatcaggtgtcccaaatagccaccctaatgatttaaatcaatgaaattcttcttgatttaaatgttaatggaaagggaaaaaaattattaaaatcctctaatggagattctcattttaatattagttttgttattattttaagccagctgaaagcaattacttgttgtcatgtaaaacgttcactaacctgttatcttccttttcagacacccagttcaggtactccgatcataaaatgtgagttctgaagaactgtctagagaaccaatagccactaaaagacaccttaataaagttgaaaaattcatgacagtctcaaaaaagcacagcaggtaacaatattgaaagctatgtctttcccatacagaatatgtttcagtcttgtcaattttaacaatctgtatgccttgtgagacaatgggttaaaatttattaaatacaaaacaagagtgaatcctcctcatgtgttatgtatactgcatgctttaaattttaatttcataataccatccattaatactggtcctaccatcatttcaagtccttttttaaatgtttctgttaactcttactagctgcagtttgtctgaaagaatcatcccttcaacctactgcactgcccttggtatcttttccttcttgtagggaaataagctcgtgtagaagtctaactgcacaaaataataagtccaagaattaggtttttaaaagaagaaaaaaggaaagcaaaatctctcttcaactaagtactttcttatacaggctaaggatcaaattgagctgcctttcagcacctctgaatgataagccagggcccctggttacacgtttttatcatgcccttactcaaagaacccttctacagcaacactcgagacagtcctgtcagcactcacagaggaccacacctgagggtggcacctctctctcatgcctctgccagaatgatgtattggcaaaagggtatttattcaattactgctacgtttcaggtgcatttcaattctcttctattaaggcaaaaagggccagtgaaagtaaggaggaattcagaatgagagagatgagaagaaaagagaataaagtgagaaagaaattacctctatgagaaaggaaataggaacagaataaccttgtatttaggtcattaagtaaatttctgccaaccaaatatgaatgagatttataaatcaacaccactcaatgacacataaaccctaaagacagtagcgaaataacattacagttcaaaagcattgagtaaataagacgtcagatatgctcaagagaatcagttgtttcaatgagtaacttcctactgttcaagattattttcattttctttacagagagaaatgaaaaactgatgggcttaattaaagaaaaacaaaaggatattattttgttgttaaaggatcaattcttttttttaatcggaatgatgattaataagttgagaatttggttcctaaactagccaatttgagtaatgtgttgtttttccacaagcatttccattaaagaaagctctatgaatgaagaaaacatacagcgattcctctcttctcctgatctctgcacttcgtggcatgaaatgctacatacagcatttgaacagaatgacactgcacactgtctccacccaaatgaactccagtcataaatttttcacctgagggtttgaatgtacactgtgaaatctgcgaggcttcctacagggaacgcacaaattaaaaaataatcaatacttttatttttcctattcgttaaactttctttaaacctggggagaaagatggcagtacaggtcaggctcaatgaggaggaaatgtggggaccctggatgtcatggccccagacatcatttctgggatgccatctgcacattttaaaacttcttagaccttgagctgcttagcagatttttttcatcttatttttcctgcatctttaccagtttttcttataggaaaacattccctctattacccaatgttttgtttctatgtgaggatataaaggctgttgttcctgaattatgtctcttttcctttgtttctctaaagcttaaaaatagatgtcagtttcttgaaagggtctttgactccctttctcctgtctccagggtccttacagtagatgaagatcgcccagcaaaatgtagaagccagctgcttttctggaaataaaaaatggcatcagctttggcagacagtagtgagatccatcacttcctaggacccccaaacaatcttctgaccaaggtctggagaagggtggtcactgagcagcaccataaacagaccacaaaagcgtaccaccaaaggtacaagaggattttcaaatggcgaattatttctacacgcataacaaaccaggctccaaacctaccgtgaaaggaaatcttggaacattatattccatgttctttggacaataacaagcagggaatcccacagaaaatttctctcactgaaaaagtcaacctacccgattcactctgttttctctacaaccacaaagttctctgacagcactctggggggaaaaaggagttaattcctagatcgattcaaacactaaggttcaaattatagacacaagctaaaaacaaattccaatttcttttcctctttccttttgatatatgtgctaatctagagtgccaagttcagaaaatacctcttgggctatacagaatcattagctattcacgtttacaaggaaaatcctctcaaaagctttgcagacagatgacggcagatgcccaatgcaactttttttaagtgagtgtgtgtaatgcatacaaggtagagagagggaggcaccagaatttgtgtttttcattcaagtggatgacgccagctcactatctgtaacggactgttcctttggaatcagctccctgtgtcacaacgacctggcaaacttgaatgctttcactatcactggagtccttgcaatcctgccttggttgtgacccattcacttctgccccaacttctcagagatgccttactcagcatctaattagtcagggaggatttgccgtggctcttaaccctgacatgggagtgggaggatgtgctgctgtggcagcccaaatctgtcctgtcactgcattaatcagatttccataaagctatgcatgaataattggatttatcagtgaatgtgaatatacactcataaatataattataaaaaatacctacaattatagataagatatctgcaccttagagggatttatttttcaactgcagttacttggctcaccttagcaaaaggctttacaaattacacaaacataatagacctgtttgcagatgacagaaaggtgagaaaattaaataatttcaaaacgatcacctactgtgttcaaattcatttaaatgaatcatgttgaaaataaactccaaatttgtgcacagatttttaacatatacaaaatacacacctgagaatatgtttgtgcatgctttacttgcgttaacgtttacatgtacatagaataccatatatataaactgttactttcccactgcattacaaatgagacggtatctcttatgtgaagtctgcatgttatccatagaccttcaaagtttaggacaaaccaagcacctgtctctatgctacaatttgtatcttaacaaatacaaatacccaaatattcctactttagtgttacattatcagacaatatactgagaattatatttgaatatatgtctattgttaaaaataaaacatattaccactcaaattaagaggggcctaaattggaggtcgtagcctagtaattcaacaggctaaaactgcatgcctcttaatataaatatttattttagcattaagaccacaagtttagtcaatttaatccttttttagtaagacaagatcatccaaacatactaactgtaaggaagggagtaaaaaatggagaaaactgcagaaagcaagctagggatggatgatgcctggcaatgaaagtcgttttcaaagaccattaactatcagctgctttactcagggctttgattaaataagaatatacatcctatgtaaaaagggatgtctatttgagtgggacagagtttagaataaaaatgcgttgtatgaactataaagaagacccaaaccacaatgtacaactaggcgtctgacttgtaatactatatatatatatgccttttaaatgactagtgaataaatactcaaaaaaattggggggggggacaaaaacattttcatttaaaaatatagattccagaaactgagattgttggcctatatgaatagaaaaaaaagatttcttgaggaaaattcatattgagcactgttttaaatggattctagcaatgttattatacatttcttatattttatttatcatttctctgaaaggtgctagatttttatattagtaagaaagtttgcttttactctgtcatatctctggtgagcagacgctctggtattaatgtaaatcgttgatttaatttttagctttcttggtttgcccctcacctatctaaaaaatgatttctctggtgataactaacacatcatgctaatgagagaatctaatgcacaatagaaaaatgtcactactaataatatttgcatgaagttaaataaagcaactgtaagagaatgtcagacagttgttctttaataagacacagtttcacaatgaaattatgttgttaattttgttacatcatcgggtgaatcctaaattactacataatgatgcagagagtcatttataatcctaacttagtatttcactcaagtatgaaaaaagaccttattaagggatctacattttatttgaaacaggttaaatatacctcaccaataataaaaggtaaatgtctctagtaacacattaaatgtgggctatagctatatacctttatggtttcctttctaaaaagatttttaaatagactggactattacatcccttgagatagctacaagaattttatttactattctctcaaatgcacaaaatatttatacaaatagaagaattgcctcctcaagtgtgattaaaaaaaaaactttgaaaagcaagcctcattttttgcttttaacagtaccttgtgaaactaaaataggcaaaataaggttctttctccacctgtcactgatcaaactgatccaaagaagaactccctttacacaagtgtcataccctttaatgttctcaaatactcagctatatacatagaaataatttgagaaaatcatacttgagtatagaagaaaaaatgtacaggcacaggaaaatgtagtcaaatagacttcacttgaactttaggggcacatacttcatcccactaaatctaaattggcttcagattgtgattatttgttactattagacagaatgaaagatgtacatttaagcagatccaactttgctcatatgaaacaaaagacaaagatttttgtatccctacttcctagtttactaatagaacacataaaactagattattaaatttcagtattcatggacatttcccacaattttctctatagttaaatactgatggtaaattatctgtaactcagttttgaaaccttttatagcagccctactagtcagagttttcaaacgtctaaataaataatcaggaaaatattagtttttatactattaaagaaaactttaaaaaaaataacccaataaattttattcatttcataagctaagtaaattttacttagaaataaaataatcataatctagagaaacctctttatgcctcagcaatgagatgtacagaattctacatatttgattaaactggacaaacttttacctgtaacaaaaactagcgtaactgtatatattgaaagtaatactcgtttaaatggctggcttcaagagatatcagagatataatttcaataagtctctctctctcacacacacacacacacacacacacacacacacgtgctgaatcagcattgctgatgaactacaggtaagaaaaacaaacatattaaatatgaacagcacacatactttcactcacatagtttgaacttaagttatgtaatatttatacaaactaaaatgtcatcttgaagagaaaaaaaatgcaagctcatatcctcttttacatgctttccaaaaatgcacaagaggtaaacattcagtgaccatgacagaaaaaggtgggttggggggataggagtgattgctaactacatcaaaaccaaaaaaaaaagaaaacatatttaaaactgtgatttctctccttttgttgtactactctatttcataaatagcataatattatacagttttaatagcatccattaagcataaattagttccctatatttctattctctccatataatcactgatgctcaccattacacatatatgcacacacaggtacacacaaaatatccacacagtcagacagctggatcaaagacatcataaattgtcctaattctgacccatcatttatattactttatttgttttttagttaaaatgttttccatgacaaaatctccttagattcaaatctacttggaaatgggctagtgccaaataagcaatctaacaccatctatgtggttcaatagccatttatcaattgatcattatctctatctggttttattaactcttttctagctagagggagacgtaagccaatcttcccttctaacacacacacacacacgcacacacacacacacgacctccactaactcaaggaaaaccctgaaggtgacatctagttttaaaagtgaagcacaagttatttggtactaaggttagcgaaaacactgcattccaacacgcgagagccacccaggcagggatgcgtcgcggaaaacacctctcacagcgctctgcagtgacaaggagcatctctgtgtggaaatgaacttttcacttgaaagaatgggaaattgcacatgaagagttacttattgggttgatgttgattgcatttaaatcccagcttactgtatcagcagtaatcagggtccctctacaggatatgtcaaaatataccttattcaaatgcatttatcctatttagaattgtgtgctaaaactgttctctagctaaatgctacaaaaccctggttgtaggtattatcgcttgcaaatgtatttctaaacttgtagtagtttatagcctggcaaattgttttttttttattatcaacaactttaaatatctaactcaaagtatttaattttcgtgaactcttacaaacaaaagctttttaaaaaaaaaaaaaaaaaaagcagttgcagtatttttttcctcttgagtggcacaacatttcttaataaccgccgtcaacttaaaatccaagtatatttgtcaatagtactttcgtgctgtgtggatgataatatcaaactaacttgctttgtgtgtggatgataatatcaaactaacttgctttgtgtgggtttggtgtaggctttggaaaagcaagacgtgtctaggagggaggcaccagggaacttccctccctcacttgagcacaatccaagatgaaagtttctgggttgtgtccccttcgcttcctctcaccctcgctcccccgcggagccaaggagccagcaattgtgcaagaggagaccggcgcacagggcgcgtatcacggagcgcatggtacgagccgccggctccggtgattaattatcagtaaccgatggcctcgcgctaccacgtcggctttcccagcagagccagcaagccgaacgcctccagcgcggccgggacggaggagcggctctggggaagacgccgaggctgcgcccgagtgagtgcgccggcgggccggcgggcgggcgggagagcgggccggagccggcgaagggaatgcaggggcgggcgcagagggctggctggcaaggaggagcggagcggaggagcgaggaccgagcagcacagcccgccacgcacgccgactcctccagcaaccctcggcgctggcagccaagcctgcacagcctcgtctctcttctcaggtctgaacgaagctgcctccagccacatgaagtcagtagggctgttctgaggggccccgagatttgatgactgttttttaggttgcggaacctactccgagagagcaaacactttggacgaagtgattcatattgatagatacatttgttgggaggtggcttttttcattctcaacagaaaacaaagaaataaattaagtcttcccctgacccagattgtactgtgaaacttttcaacaatgtctctgctttcttttacttcggtatcctttcccctttttcttttaagacgcccttagggaaaccatgaagtaaccctgcacattccagtaacacagttatgacaaaacaagagcctaactaggaagtgaccacattttaaaaagtatttagaaagaaaaacaccagaaacaaaagtgcccataacaattcaaggtttcttaaaaaaaagaaaaaaaaaatcaagaaagaaagtaacttacctgttgggacattctgaataagaggttagtatcagcgttttgccatgtccccatgaaccctggttcagccgtagtcgttctggttccgaactgcatggagttgtcagtacaggagtctcttaaagtcaagtctcttgccctctttggctctctgtctctctgtgtctctctttctctcacatccacttctgcctcttctgactgaaaagtgaaggtggattttttgagcctcttggcagccagtagcaggagtgtagtgtagttaagaagctggctgaactgtgcatttcatttgggaagggggagatttgggggagggagggggtcagagcttctttcgcaccttctgcacagatatccctatcatttatgcatagattgtgactccccaagcttgcctttgctcagtttaacagctgcctgtcaggtgtgcaggcggcactggagacccaaccatcagcttcaaactctcagccactgcatgtcattggatagcagagctaagagtcaactgcactgttccactgtcaggcaccaaatgacaccctgcactaacccctctccagatatacagatagatacacacttatgcacactccaggcagcaccacaatcacggtgcacagggcaaggggaagctagggcccttccccgggaatttttctcaacaatgctttctgatataacacataatatctgacaccagtctttggctttaacatttgtaaaactgtgatacttaaatttttttttaattacactgaagaaagtaaaatattcagctgtaagagaatgtaaagttggctcagttatggtctaaatgttagctcctgaaagtcatctcgtatgtgctgggctatttataaccacatagaaactcctaaataacgtacatagagatgtgaccttatactctaaagagtaagcaaataagcctagcagtttttataacatagaagatgcacaataaacatttgccaaatataaatatatactatttaatatctagtacctcaggctattaattactaaactggatgttagctaatgagaaactgaatggcaaaggaaaaaagtataccttttcttaaagctcagaagtagaaaaaaatcctttgttaaagttcctagatgaagcatctgcaatatcctttcaaatcgttaagaaaagaaaaagataaacaaaaaaagcctgtcccatttcaggcaaaaagtaatgaatataaaaactccattttttattcaagatctctgtggaaaattctataacgttttcctgcctgatgaaatacacccttgataacatgtcgtatttttaattaaacaagtcttaaaactattcacctatttattagatagtatttgtctgccttatttatggaaaagcagcactgaacaaaatgcactgtacataaacagtaagttcaaaatggaaagctaaattcatgccatctcataaaagtagtcagcaggaaaaagccatccttcctaaacttaacatgtaaggaacattaatcttcaaccacctacaaatatcgaggacaaatgtaccactctccttgttccttcttaactcaagaataacaataaaccttactctctgaaacaacaaaagaaacagaaaagagcttcaatggcagctctgtgtcattagtggacaatgagaaaagatgagaaaacgtacactatgttgacacaaatgtgccttcccctctagaaccgacatctcctgaaagcttttctgttaaacttccctccagttccccaccattaagcacaaaaaagtctcaaaagaagcaaattcaatatctgagaggaaacaaacaagaacccaaagaattgttgccttaaaatatattaagtccacctgtggtcaataaaaatattcttgctgggggggagggcaggaaaatcccctacgagtcaattgtcaacagtgactgtacctttagtgctagctattacccacttaaactccctctaaaatttgctagcctcttgatttctgaagtggcactcagtgcctcagtcaagctgcctgctcagctcctgaccttcccactaatggctgttatttgtgggaggcttaaggacactgtcaatagcaagcttcctcctccttccactcaggctctgttgtatcgctttgcctgtgtgtttttgcctgtgttctctctcgcctctcactcgccctctccttgtctctttctccccctccttcactccctcttcctctttttctagcccccaccccgttttttctcagtcctgcagtcctcttctttcccaggtatcctacccaacaccccacacacacactaacaacacaaaaatcaactggcatgcagcagcaagcacctgcagtaatagactcttttattaaaactgttattctgcaagacttgaaattccccgtggaccgggccatgtcaaagccgatataattaactagaggctcagcaacggatcaattaccagacaagcaagtgatagtgaaatcaatgaaagatcatcagccacattatcagtgttgcaactcattagggcaaaactgagaaatgtgctcaaagcaagcccaagcaaggtggcattacaaaacaaagggctaatttggagaccctgctgtgaacaatctgtaacagaattagccttttttccccctaaactgcacagctccgtaactaaatgtgacagactgagagaagcagtttattaagacaccaaccccaagtttatttagttcataaactctctcctagaaaatcaatacagtctgtacagggttattaggctgactagctaatacatccaaatctagtctgcccagccagcagtcttctgacaaaatgctacccagtataggcaaactgagctccttcagatatcatggactgaggtggccctggctgaaacacgtctgcaatataacatgttactgccacaacacgagccttaaaagcagcaggatatctttctaagttttaaaaaatattttttcataaatatacagtactgcacctgctaaatggatttgctcaaacaaaatcttaactactttgtaacacaaatttacaaagaggacaagctctgttacaaaaagagacaacaattaatccagactcaataataaataagattttaagtttctctaacactcattttaaaataaatatttgaaaagaacatttaatccctctataaatccccaagatacatgatctgaacttccacatataacatactgtgtagaacatttgacattaggataatttctatctagcaagtgggacatctgtatcgttttacagacacaggtacaaaaaaatacacctacaaggcacaaatatgtcttctgagtttttttcactggctacatagtctgacaattatggaataactctctggaatcatttatatgaaaattatttaaaactagaaggaagaagacaagtatcacttccacaataattgctttttgctgctgattctgagtatttcaggttaaagaatcagaagtacttaaaggccatctgttggctttcccacatttactgatagtgagagatggaccatggaaattatgaagtccaccaaactaggtttcactgcatccaagttaaagacattgtgtgaatgtgaatacttcccccacaccacaccacataagtagaaatatacttacacaaagtaagaaactcaaaagcattttacaatggtaaaatagattggagaactgaaggggaaaaaaaggcaatggctctgaaagtgacttctgatgttgatgatgttttaacgtttaaaatcttccaagaaaaggaatgcactataacatgcctttcatatactggctctaatacactaaatcctgaacttaaaaagaaatctttattttcacataactatagtaaaattcaatttatagactgctgtaattaaacattttccctgtaactttcgagctgacaccttattaagcatttcatagctcatgtttttgagtaatctgtaaaaaagtcagacatatatattctaaacctgtgctataggtaccatgttttggatagtaattaaaagttgtaattgcaggaaaattttactttttaaaacctttttgcatataactacacactgtgcatgtaccctcaatgagatccaattagttacaaaaaatttgcatttcagttagtgtgggataacaagactatagggaggcacaatgcaattccaccagcagagtaaaaaagtgtgttctttcttgttagctctgtaagcaataattcccacaaccgtttaaaatgttactgatcttttcagtacttgagtattacggtgggttttgggtttttccctccatttcctgcaaaaaaaaaagaaaaagaaacaaaaaagaaaaaacctatgttggtgtaaaaaatcagccacaatgaatacatgaaaacgcaagtgagcaaagaattttgttttgcatgtatgtttgtagggtgttttctttgaggggaaggggatataacctatgttttcttctttctacttaatttctttaaaagcacattgctttcataaaataagttatgtaactgcaggcaaaaaaacctcattgagttctatgtaaatatatatgattttatgatgaaagcatacatttactgcactgagaaagtactctaggatttttattttttctgtctccaacaatgtaaatcctgcacaaatataaaataaatgtgtagtttttgtatacaatttaacaagcatctctagaacttctgctggttcacagaacaatacctgtaattccctgggttgagttcagcaactgttaacagattctataatctgtaatgtgctctgcctttgctcttcttttattcactattcattttcaaggcttggttaagtacagagctgggttaaagatcagtggtttttcatgtgacacacgctggtattcatctaatggcttgtcaagacaaaactgtccctgttcttgccaaaataataaaaatgacgctccacatcgcatgacaatcagcacttccttatggcgaaacaactcaagcttttgtaattcatttattttatagaaaaaaatgttaaaaactggctatccaatcttatatgtggactcaggttgccattctcgaagtagagttttaaaatgttttgccctctcttaattctacagcaacatgtaaactagtttctaatcaaaccagactttaccatgtaaaaataatgctgaagatacaaattcatatggcattaaggtatataacttaatatatgcaaattatgcagcaggctggactcagtcacagaagtgggggaaccaactaaggaaatgtcatttttcttgagaacaaagtatgggacttgctctccaacatctgttgggctgtgtgaaatgttaacagatgtcttaagtgaaaaaagaagtaataaaggaaacctcttctgaaaagataatccacccaaatttccatattcctgaggaaagaagttgacagcaagctttttcccttgtgaaacctgccatccttactttattgtgtaaagtttcattttctatgtgaagttaaggggaaaaaatttttgactcactgtaaagaaatgaatagaaaagaagtaaaacaataatttcaattcaggttttccctttgtaaaaaattatatcataatttaagctgcctgttttccctggactcacatatgtaaatagatggaaagacagtaaaaagttcacctcctcccgcccaaaaaaaaaagaaaactacacacacaaagatgaaatattactctactatgcttacattaactctgttggcatggagcggggagaaagaggaagagtaaagagtagcttgtaagataaagttctgatatgaagccatctctactcataaaggtactcatcttcacaattaagattcacctatcattagccaggcatggtggcaggcactggtaatcccagctactcaggaggctgaggcaaaagaatcgcttgaacttgggaggtggaagttgcagtgagccgagatcacgccactgcactccagcctgggcaaaaagagggaaactccatctgaaaaaaaaaaaaagattcacctatgatttacacctaagtccctgcactctcccactggctcctaatttcctttcattacatccttatgagagatgaaacactcctcttacaacagccaagtgttccacagcagtaaagtctgatattcctgaaaaattttggagaatactagttggatccctgtatttaaactttaaggaacctggacagctactttcctagttaacaattctcttttgggtttcaatttatagatgatctagccaagcctaaatgtagcagcctttaattccgattaacatgttgatgcatgcacgccaactactggatctaacctagtgcctatctgtgaatgaatgaactatacacctatctgcttctgtacgtcttcctctttggaaacgcctatattctattgcttattctcttaaaaacctgggacatgaatttgggttaacagcttatagatgaacaaattcaaagtgctcttaagggtctttacagattcaaataggaaggaaaaagcttgtgtcatctctgattgccagcctcaatcactggcccctctcattataagagtccattagaattatacatgtcacttcatatttacaactctaccttctccagatggttctggccaccttgactgggcatttcaacatacagaaggcttcatcaaaacagcctgaagatttcaaggggcaagatcatggtccaagttggaaataagacataaaggcatgccttcagttttcagttagtttggtttttgccaaagtattgtgagtactatatggtccagtgtttacacataagaacatgatatccaagcccgtgacaaaagaaaaaataataaccactcacctacagggagggagaaagcttgtgtgctgaagacttcattacatgcccttagaccaatagaggaaaataggccttctaacttaaggttggaggaggacacagggtcaaatcactttaaacagtggcacaaacatcctccataactaaatattatctaaaagcttcacccttctcagcaaaagggagaaactgctctagctgacacgtgtgtctgtaccaactaaaacaatcaatgtaatacagtatctgctgacagcctaatcaggggctcagtttcatagaaacacatcaaggaaatatccaaaagccataatcccttgatgcactacaaaaattttaaaataaaaggatttgagtagggtatggtagatgaggtagtttacaaaatgttagggaaatgatgaatccttagactcaagatatttgcagataataaaagcagctgaggtcagcatgaatcttgtgcctacaaaaggtcaaacattttacctaccttgttttggtttaaaaaaagaaaagtgactttattaatcttctctcaagtccaaacagtaacagtggcttctttataccaaacctatattcaatgttttatgagaaaatctagaaggaaagaaccagtgatggctttacttaaatgaatttaaaaaaaaaaaaaaaaaaaaacaggctgggggcgcacacaacgggaaattaacatgaacatgaaagttgcaagaattataaaggtaatgttaatttctttgttttttgtttttgttttgagacaggatctcactctgtcttctaggctggagtgcagtgccgtgatctcgggttactgcaagctccacctcctgggttcaagcaattctcctgcctcagcctaccgagtagctgggattacaggcgtgtgccatcacccccggctaatttttgtattttttggtagagagggggtttcaccaaaccctgaccaggccaggctggtcttgaactcctggcctcaattgatctgcccgccttgcctcccaaagtgctgggattacaggggtgagccaccatgcccagccaagataatgttaatttctttatttacttccttctaaagtctgtggaccaagaagcttgcagcctcagtaaaggtgtcataataatggtttaaattactgtcagaaaagaagattgagattcaccaacatccaagaaaatcatgttgcaggccaggtgcggtggctcacacctgtaatcccagcactttgggaggccaaggcgggtggatcacttgaggacaggagtttaagaccagtatggccaacatggcaaaatcccatctctactaaaaatacaaaacttagccgggcatggtggcgcatgcctgtaatcccagctactcgggaagctgaggcaggagaatcacttgaacctgggaggcagaggttgcagtgacccaagatcgcgccactgcactccactctgtttccaaaaaaaaaaaaaggaaagaaagaaaaaagaaaaccatattgcaaggcagagttcagtaccttacaaaattattgagaaactcaacactgcctttagaattatcacaggaaaaagcaacactaaaaatgatactccttcatatgcaatttacaaacctaacaaataaacttaaaaaataaaatcccagtatacttaaagtttcaaaaatttttatagaaacagagactatttattattattattgtttattattatgattatttcttttttttttttttgagacagagtcttgctctgtcacccaggctggagtgcagtggtgcaatcttggctcactgcaatctccgcctcccaggttcaagcgattcttctacctcagcctcctcagtagctgagattacaggtgcacaccaccatgcctgggtaatttttttatttttagtagagacggggtttcaacatgttggtcaggctggtctcgaactcctgaccttgtgatccgcctctctcggcctcccaaagtgctgggattacaggtatgagccactgggcccgacctattgttttttttttctttctgagatggataatggatacacttttggcctgcctagctctttcactcttgttgtgcaggctggagtgcaacggcaccatctcggctcaccgcaatctccgcctcccagattcaagcaattctactgccccagcctcccgagtagctgggattacaggcatgcacctccatgcccggctaattttgtatttttagtagagacagggtttctccatgttggtcagactggtctcgaactcccaacctcaggagatccacctgcctcagcctcccaaagtgctgggattacaggcgagagccaccatgcccagctcggcctattattttttaagagctaggatcttgctctatcgcccaggctagagtgcagtgcacaatcatagctcactggaacctcaaactcctggcctcaagcaaccctcccacctcagccaccacacctggccttttttttttttttttttttttttctttttttgagacagtctcgctctgttgcccaggctggagtgcagtggcgcaatcttggcttactgcaagctccgcctcccaagctcacaccattctcctgcctcagcctcccgagtagctgggactacaggcgcccgccaccacgcccggctaattttttgtatttttagtagagacgaggtttcaccatgttagccagaatgatctcgatttcctgacctcgtgatccacccacctcagcctcccaaagtgctgggattacaggcgtgagccaccgtgcctggcttttttttttttttaaagatggggtctcgctatgttgcccaggcaagtctgggaactcctactctcaagcaatctactggccttgatagagactatttatatacatacatatttaaatcgaaaaatgttgaaacagagcaaatgttcatgaacttagagattgttttccaaatgaagaaacccaaaagatgccagaaacctattaatggcaagttaaaaatacgaagacttaacaggtcccttagaagatctgcatagtgattggctttgatggagaatagtggctgggctaagggacacttttggggttcaggtagtgttatgtatctccatctagttggtggtcctgggtatattcagtgtgtaaaatttatcaggctatacacttttatttgtgcacttttctgtaagtatgttaaacttcagttttaaaagtttactactaacactattaatatagtattattattaaaaatagtgataacaataaactagccctagaacaataggaaagaaagaatagaaaaaggaaaagagaagtaagtgcagggagagaaacaatagaaggcagatactttatcacgttcaaaatcattcaaataaccatcattaaatctactttcaattatttcttcagaggcaagaagtgttaggaagcaaataaatacctgagtttcatagaatgaggataagtatgaaagacagtaaaagagtggcagaaagaagaggtgagagatatatcttaactaggtaatcaaagaatgcaagtgtgtccaagtaacttaaagggggaaaaaaaaaaccaacatacctcaatttgagatgtatcaaccccacaacatgggaccttgaaatatgctggccagtcttgctcactaagcctgtcctctgatttgtaattaaggctatgtggaggtggggtgggcccaaggtgtgcctattgagagattgggaaaggaaattacatatgcccagacagtattacttaaaagcattgagtacatcaaaactttaagaaattgcaaatataacacaccaatgaccaactaaacacattttttaagagttaatagtttctaaggctgatagtagccaacagctaaataaactttggtgagaactaaagtaacaaagtgggaataactgaataatttgctgattgataatggatacacttttgccctgcctagctcaatttcttactcccttttcttccacttaatatgacacttttaactgctgttagggaatactaatcacccccacccccatcctcccgccccagccccccgccccgctcccttgccaagtataagaagctgtggagaacacaaaagttaagacatactccttgctcacaagtttacaatctagtacaggagataagctatgaacaaaacaaccttaacaaaaacagaataggaaaagaaacaagagcagaattccatacaacttagagatcccttccagccagtatggtttagaaaaaaaaaaaagcttctacaccgaggcactctcacactgagcgtagattatattcctagagaagtaatacagtttgactggaacataagggaagatgtacatagaagaaccatcaatgaaatggatgcagtggttgataggaactattataaaagtaagggccctatactccactacaaagagttgctatttagcctgttatctaccaacagtccaaactaccaaaagcttctcaacagcagtaacgtctgatcattattttgctccaagaagatttatctggcaacagtatgacagatggactgaagtgtgaaaagacaaaagcagggtccaattaggaagacattaaaataggccgggcatggtggctcacgcctctaatcccaaaactgtggaaagccgaggcgggcagataacctaaagtcaggagttcgagaccatcctggccaaaatggtgaaaccccgtctctactaaaaatacaaaagaagttagccaggtgtagtggtgcatgcctgtagtcccagctacttgggaagctgaggcagaggaatcacttgaacccaagaggcagaggttgcagtgagcggagattgtgccattgcactccaccctgggcaacaagagcaaaactccatctcaatcaatcagtcaataatctgggtaaattactggcaatacggctggagaaaaaaaaaaggacaagatacagaagatactgtgaagataaaatcaaggggaccagaatgactgtaacaaatgagaagtgtcaacaatgacactaaagttctaatagtctgagcacaggaaaatggtagcattatcaacagaaagggggatgaactagtttgtgagaatatatagcaagtttagtatggggggaacagcagatcatgcagataaccaggcaactggaaatgttagaaaacagactgatactgaagttatcacatccagcagccatctacacagacctgaaacaagagataaaacaagtggccaaggttagtatctcaggggatatccatggttattaggggaaaagacagaaggaacagcgttaacaggagcatcgtgattgtccaacgttccacctgataagggaaaacagttgacagaagataggatgcttgagagttttaaatgatctagaacaacaagacttatatttagggtatggttaaaaccaagtgaaatagtaagtagaagcaaatacagtaagagcaaaccaaaaggcatgggaataataaataccaaaatcagaatagtgcttaaggatggaaaatggggaaaggcagatagggagattgacagtgactgacacagtataatttaaatggtaactctagtcttcagatgtgtttgtacattattagttcctaaactcgggtcaatgagtgttcaacataacattcatgtatatttgtggctaaaatattttattaggctttgtgtcataagagtgaatgtctttgtagactgataggtatacagaatccatattgcagaggagttaagaagtaagcaaattgtgaagacaaagaagcagaaaagataaaacattctttggagaaattctgcaaagaaaacaagtaagagaaacgtggtctgaaaagttagaggagctcagacaggttgtgttcataagttggcagtttgtttttcactacagggaaaaaagagactatcacaggcaaaggggatgaagccaagagagaaaacgatattgaagatctaagccagagggaaaatggtatgaaagggtccgaggagagaatatgatcaagagcacaaatgaaaagggtgcccctggagggagaaaaaagaaaccctttttttccctcagaaaccaaaggtaagagatacagaaaaaaaatctgtggttaagaaatacatatattaaaactgctcatgttagaaaaccaatttattaccaattttttccactaaactgtacacttcttaaaagagacagaatttatctttcctaattcagggtctaacagggtgctcaataaataacagctacatgaacaaaataatcatctgaggaaagttaaagatggggctatctgctaagggagacatgataggaaggaatcgaggagtactagaaggaagaaaacattgggtccaactggaaagggtaaaatgaaactctgctataatcccagcactttgggaagccgaggtgggcggatcacctgaggtcaggagttcgagaccagcctgaccaacatggagaaaccccgtttctactaaaaatacaaaattagccaggtatggtggtgcatgcctgtaataccaactactcaggaggctgaggcaggagaatcacttgaacctgggaggtggaggttgcggtgagccgagatcacgccactgcactccagcctgggcaacaacagcgaaactccatttcaaaaaaaaaaaatgaaactctgaatcagtaagaaatgagtaacagaaatggcaaatagtagaactcagcctggttcccacaaaagcgtgagaaataataaacaagctgactgggtccaagaaagtatagctcagagttcccagtttgggaagtgaaatacttagaaccagcaaggagttctggacacaaagagaaaaataccttgctctaaaacatgcaccatgacaggtgcggtggctcacgcctgtaatcccaacactttgggaggacaaggcaggtggatcacctgaggtcaggagttcaagaccagcctggccaacgtggtgaaaccccgtctctactgaaaatacaaaaatcagccaggtgtggtggtacacgcctgtagttccagctacttgggaggctgaggcacgagaatcgcttgaactcaggaggtggaggttgcagtgagctgagatcacgccactgcactgcagcctgggtgacaaagtgaggctccatctcaaaaaaaaaaaaaaaaaaaaaagacaacaacacgtataccttgatgggcaatagtatgatataaatcattgtcattatgcagcattctcatagtgtatagttcttatgaagaaaataaagtaaaacactgagaattgattttggatgaaattacttagtctttgtttaggttttcccaaattcgaagtgtttagtatgtagtggtctaatgtctatgaatttatttctggctaggaaattccccaaagccaacaaaaatcaaaatactttatgctatgtcacctatgtgatttgaacaaaggcataaaagatgtggaataatttcacttcattaataaacataagacaaagctgaagagagccaagttccactccttattgcctgatttctgtctccagaactgcaattgtggtccaaagtcacaccagctttctgcccaattagcaaggtctgcattagcagaactcagcacttctagtccagaatccctctggagagcagggaaatgatgggttccatcacctggccaacatcagcaaccgccagagtcaccttagggacacagacaaagacattcatctactatactagcagcccctacagcctgctttcctaacagagtcctttctgtgaagaccactgtctaagtgacctgtcatagagctttataaagcagcattaatactgtgggccaaaatgagattgatctttgagcttcgtggtctcctgttgtcaacagtgcattataaaaccaatactaaatactttataaacaggtctccctacagtatattagaaaaacagtgcatatttcatgccccatagttaggtagccacatatccatcagactaataaattatttattaggtgctcagaagtgcaataagagtcaataaactaacttctggatacttataagctactatttcactggaaattgtacctgaatgagaaaactgtctcactaactgaatgggggatggaaacatctcagctctctcaagtgtactgtcagaaggaagcatggacctcatgagtgagaaaggacaaaatccccacaccctgaaaagagtcctagttattaaattaccaagaacccatgctcatttcttttctcttgtgtatagattcctctggttctaccatccttggagacagctcagggaaataaaaatcggtggaaacatttctaacacaccctgagtcaggccagatgacaaccaccaacgatggcttgcatttgacatctccaaagaaactacacgatgacttgagtgtacaagctttctgctacatgcatagcacagaatttcgaatttattaatctaaggtttagaggagactttttacttttttttttccccatgtttggttaaagctcctaagcctacagacaccctgtgctctgtccaacattataaggcatctctttcctggttctacccctctgaaagaggaccttccattctagaatgtattctaggccttcaaaaaggaatttcttcagacggagttatttctcaaactatcagaggcgtggacctttgtgtagtattgtgggtgtcatggtttcacatgttggccacattaataccggagagcaagcatctgtaacccacagctgtgtgtgctccagccccaaagcacccgcagggctgatgccaatgcaaaccactcttcccatcccacatctgaaccacactggttttcttcaggagccagaggctgagatacagttctgaaaatgaaggtttggggttctttccattcacatgatgggtatagggtgttgagaggaatactgccagatggactggctccttttttctcccccattccataccaagtgagtaaaccataaagaggcttatggtgtcaaagggtattccaaaataccccaggggaaaaacctaaatggataaatacatagattttgttcacactattctcggtttttttcccctaccatcttatacttttattcctacagactgcagtttgtttgtttgtttgtttgtttgtttggagacggagtctcgctctgtcacccaggctggagtgcagtggcgcgatctctgctcactgcaagctccgcctcccgggttcacgccattctcctacctcagcctcccgagtagctaggactacaggcgcctgccaccacgcccggctaatttttttttgtatttttagtagagacgggttttcaccatgttagccaggatggtctcaatctcctgaccttgtgatccacctgcctcagcctcccaaagtgctgggattacaggcgtaagccaccacgcctggcctagactgcagtttttaaggttgaaaaatattttatgctggtatgaaaaagtggaactaaaggaaaaacgtgggagagacttagtttcacatcactttctcaaaaagacctcccaaatcctacaaataatgaatgctaatgtaaaaatataggagaagactggtttcttgtattacttttgctactacaaccagtactgctaagatgattattcatattaatgagtttggtatgtagacaaactataaaagacgcagtctctgacctcaagtacttatctctgtcttctgggatttactcctcctgctagatttacttttattcttcatacccttgcccagaggaagggatcatcactcaggacttggagcatttccatgggtggggtttaaatatgacaatgagaagaaagagaacttttgcccttggacacagacaacgttggccccaaagctcaggatgtctagtttgtggcaaggagaaatataaactccctgtgaaatttttacactggtctcactgagctttatcagaaaaactgtgtaaaatgtgaaagcttatagcatttcagtgctttatcacatcatgcccacatatgcaaacatatgtacatgaatgaactaatagtaaacaatttctcttcatcctttatagtgttatttacattttgtgtgtgtgcttagagcatatatagaagaaacatatccaggaaatcaattttgccaagtgcttaagtgtcagagttctgcagcgcaatttcttgggtttgaataactgcagaaccttttactaattgtgtgatcttggcaagttacttatccaaagttcatctctgaagtggaaataaaagtacctgttcacagaattgttgtgaaggttaaacatttttattagtgcaaaaggtgtagccaagcgcctagcatacaagtactaaagtatcagttgctgcgtaggtacgtgtgtgaaaagacatttcaaagtagaagaccacaggccaagtttggcttcagatgtgttttgcttggctcctcctaagtgagtgtgtatgagtgtgcatatgtttaattaatgaccaacatgtaaaacacaagaaattttaaattaaaatatggatattcagctgctgagggaatgggcagggagaggcaaaaggtgaggcgttaaagaattaaagatatggtaacagaaacgtatgttccttcctgacaacaatcagcaagggaggagtagaaactactctctgcagcacgtactttcattttataccctaccaggttctcgcaattcctttacttgcctggccactattgccatctaagttcatgatgcctggcctacaagcatccattagcatatatggagagttcattcacacataaatgaaagtcatatttaaataaagtatcaagtaccaaaatgttttctattatgcctgtctctgataaaaataacactgaattgcattccattacttttccgttttcctaaaccctagattgtttactgtagtatatatataaggaataagtaaacccattacatgtgactgtatcaggggccctgctggaagtacagacatgggctttgagacagctattttttcagtaacagtggttctcaaatatatttgctttaactaggggagaccttttttgaaaagaaaaaaatattgatattgtgaatatgagacaagtcgtataaagcctgggctccttggcttctgcagccttacacacacagaattgtaaggtcataccaaaaaatcttaggaaacagatctaatcccattgctttactatacaatcaaggaaactgaggcaaagtcaaagaataaactggtagcaaagcctggaccatttttcacgaattggttctcctaactatgtttacaccggagctcaaagcagtcacccaggaggttgataatctagtagtataccagatttactctttgcgacttgtgagaactgactattaaatttttaggaaacttacaagccagttgacttcatattggccatgttgaacctgactgcaatcagtgtcagagccccccacatttaaccctatgaatcttattaaactcgtttttgttttttgtttgtttgctttttgagacagggtcttgctctgtcaccaaggctggagtgccatggtccaatctctgctaactgcaacctctgcctcctgggttcaagggattctcgagcctcagcctccagagttgctgggattacacccatgtgccaccacgcccggctaatttttgtatttttagtagagacagggtttcacaccatgttggcagactggtctcgaactcttggcctcaaatgatctgccctcctcagcctcccaaagtgctgggattgcaggcgtgaacaaccgcgcctggcctaaacttaaaattcggccaggggcagtgtggctcaggcctgcaatcccagcacttttggaggccgaggcaggcggatcatgaggtcaggagatcgagaccatcctggattaacatgatgaaacctgtctctactaaaaatacaaaaaattagccgggcgtggtggcgggtgcctgtaatcccagctacttgggaggctgaggcaggagaatgaagtaaactctggaggcagagcttgcagtgagcagagattgcaccactgcactccagcctgggtgacagagcaagactccatctcaaaaaaaaaaaaaattaatccatgtaattgaaaaagaattatactttccacctaacagatattaaaacatctgaaattcttcccatttttaaaatatacaaaatatcacaccacgcaaagaaatacaaagtatactacgaaagtacagattattaaaattttacaagcacaaccactgcttgagatgttgacatttggccaagttaggcatcttcacagggtacataaataattaattgtccttgtacccgcttctagagatttgagaaatttcatgaaaagtttcaagaaaaccaagccagactcttaagaattacagaataaatctacacataaatgtggacttcttactatgtacaagacattgcaagttttataaaagatacaattaacagtaaaatctcagcatccagagctcttaggaaattaatcattctggaagggcacagagtcaaggagatggaactttatatttattgagcacctgttgtgtgccaggtactatgcaaaacataaaagattttttcattcattcttcacaagtcctctgagataggtattattattctcattttaccaataaggaaatcgaagctaagagagtttagtcacttggccgaagtcttatattaagggtcaaactgggaattcaagaccaagttggtctgatttcaaaatatgtgctcatccaaatatccagcattgcctctccaggtttctaccattttagacaagaattttctgaaaaggtgctgcctattaccctgttttaagcaggacatatctttcttgataattaaacatcaattaatatctggtaatatctttaggcttctaagtgcttagggcttcctacttgacttggcatgggaaagaggagctctgggaaggctctgttttcttaaattcaactatctaccattttatcctttcatagttagttataattattaattgtttgcctaacatttgccttcttcccagttctagaatttgctattttattttactatgaatctttccaatggaatattaagtagtcattaagaagaatggaaaaaaaaactgtaaatacagataaacaacatctccaaacaaaacatgagtaaaaggcaagatgcagaacagtaaatactgtgtactatcatttatggagaaagagaaaaacaggagaaagagagagtagaaaagaaaaactgaggaggtaacaaatacttctaaaatggggctaagctattgctagaaatacctttcaggatctggcaaataagtctgggtgtgatggctcacgcttgtaatcccagcactttgggaggccgaggcaggaagactgtttgagcctaggagttcaagaccagcctgggcaatatggcaaaacccatctctacaaaaaatacaaaaattagttgggcatggtggtacgtgccaatggtcccagctactccagaggctgaggtgggagggtcacctgagcccggggtggtcgaggctacagtgagtcctgagcgtgccactgcactccagcctgggagacagagtgagacattgtcttaaacatttaaaaagaaggaatccagtaaacagaaaaaaaggagaatttgcccgggtgcagtggctcatgcctgtatcccagcactgtgggaggccaaggtgggtggaccacttgaggtcaagagttcgagatcagactggccaacacggtgaaaccccatctccactaaaaatacaaaaattagccaggcatggtggcagccgcctgtagtcccagctactcaggaggctgaggcaagagaattgctaggacccaggagatggagattgcagtgagccaagatcaggccactgcactccagcctgggcaacagagcgaaaccgtctcaaaaaaaaaaaaaaaaaaaaaaaagcaatggaccatttgttttctctgtgtaagcttctgtactttttttcactttttatactatatatatatatatatatatatatatgaaattaacaaaataaaaaaattaatatataatgatggccctgaaaaccaaagagagttttggaattttcaggttctaagcaatatatgggggaatgactatcttagaaattcagtatgtaagcttgtaagctttgtttcattctccaggatgctcaaagcacagttcctgcctgcttttcaactgtgctcatattagcccagtatgaatatttaaaacaaagtcctctgatttcacatcatttacagtatagctggagagactatatgtaaatgtacaagttaaataaaagatgtaaataagcactctcttacaaaagtagaagtctacaaatcagtacacgtgttgttagttataatatatccaggaacatacgttatttggttaaaagagcaatttgagccaagattcttagactaaggagaatatcaaaaggcaaagagaagagaacattccaaatgggtgggggaagcacgaataaaagtataataatcccagcaccctgggagaccagggcgggaaagtcaacagcttgagcccggttgtttgagatcagcctgggtaacagagtgagatcccatcgctacaaaaaaattaaaaattacccaggtgtggtggcacatgcctgtggtccctactactcaggaggctgaggtgggaagattgcttgagcctggaaggctgaggctgcagtgagccatgattgtgccactgctctccagcctaggcaagagagagagatcctgtgctttaaaaaaaaaaaaaaaatagtgtaaggatgtaaagatgcactgttccttggatagatgaaagatattatttaataagacatgagattagaaagcgtatatacaggcaaactgtagaggccttgaaatttggacttcaaatttctgaacacagtagttaagtaacagaagttatgtttcatctaggaatggtgaatgcagcagaaaacagaagtattaaattaggggatttgtttgtattcaaatattcccctagaacataagctctaagaacgaggaattttatcagttttatattcatttacactgcatgcatttacacttgaaactatagtagacactaataggaaatggacagcccatcacagagcatgaggacctaaactaggtaattgtgagaaataaattaacaatttagagttttgttttctgttttaaagaatctacgagaactgatacctaaaataattttagctctaagggaaaagaagcaaaagataattataggatttctagttggaaaaaatggtgaaggtagaaatataatttgatacttatatttgtaccaatacatgtactatacagttaaaatatttctacctaaaaatattttctgaaattaaaaatggctgaacactaaaattatgctctatcttcaattctctaccatctactactgactggcatcacacccaacagcatatggctttaccactcatctctaaactaatgtcatatcattccccttacagaacctacttttgccttgcattacggagatgttagacatcatctatacatttgaccagtagatcatctatcctgtcagatgcgaatgggcatccctccagaatgcctggcatacccaatgagcaaatgcaagagatctctcaaacaaactctagaatctgccagatttctacaacagaatatccttcttacttaggtcccaagttcagtatctctgaattagaccgtaacacattcttgccaaaaccgctgccaccctgttttcaactctttgttaatgaacgattaagcctcccactcatcaaggcttgaaagcaaattcatgtctgcttcaccactatattcctaccatgcttggcatgctgccacatattcagaaatgttgaaaaatttgggtgaatgaatgaacacaagatgaataaatgaatgattacagtaacacagaagtttctgggctagggagatgaattcaggagatgcttccactgactggtacttcagcggcaatggcaggcattgctaaccaagtacagagttgtgtcttttttctctggcccacctcagactctcaaagcattcaccaaccatcagtctaaattcacccacaagattaaatatatctgtcatcccagaattataccttttttaacattccaaattggtatcatttaaaaagcttttccaggtaagcacaaggaaaacatttaaaacatcactgaagtctaaaaaaaaactacaaaactgtgaaataaaaaaaactacaaaactgtgaaaacttaattctaaaatattctcttaaattgcattgaaaatggtttaaaaaaaaaaaaaccctagtatattgtgagcactggagtactggatgagtaaatgtaaactaaggagctcatgcgttctccatgatccattcagcacacaaatgttacatgctttcaaggaaaacacagtatcacatctaagagatcagcaatgaactctctcaagaaaaagtcttatctttgctccctttcaagaaatctccctatctctcgacttcccttgcattgcagattaatttttctcaaaataaaagtaaatatcaaacactgtgaagagtcataaatcatataaaaagttattattgttctagaaatataaagctgctgtccccagcacaaatatatatatgtgtatatatatatgtatgtatatatgtatgtgtgtatatatatatgtatgtatgtgtatatatatatgtatgtgtgtatatatatatatatgtatgtatatataaaattaaagatttttaacaattattttcagccaggcgcagtggctcacgcctgtaatctcagcactttggaggccgaggcagttttatcacttgaggtcaggagttcaagaccagcctggccaacatggtgaaaccccatctctactaaaatacaaaaattagttgggcatggtggcgggcgcctgtaatctcagctactcgggaggctgaggcaaaagaattgcttgaatccgggaggcagaggttgcagtgagcccagatcacgccactgcactccagcctggacaacagagcaagactctaaaaacaaaaatattttcatcttaataacataaagatccagttttttatgtacggtaacttgaactcctagctgaagactgttctaataatttcttttaagaaattacgtcttttaaaaaataagagatccgaagataaactgggtttacatttcagatgataagctgttttggctcaaaattttgttttgttaagttatgttttaccagtgcttgaacataataaacaaactactatgaaaaattaaaggctacaatatttgcaaatgctttcacttcctttttagatagtccaaagcctactgctttaaatacaattaactataacctgaaagtttagcttcagggcacattcagactgtatcttcacaatattaaaacaactgatcaatgaagtcaatgtgtttgggcggcagtagttaagtcaaatgagacgtttcatgctgttgtacacaaaataaccagctgactgaagctgtgaattagtagtttaatcttagaagtaaaattcttacgcagtcttagagaacaagtcattcttacaaattacttggcaatcacacattttaaatacagcctctcaaattgctagatttttttaatgacacacaagttacaaaataatctgtatagttttctttttattctagattctctctctagaaacatatatatcatcaagtaaacaaaatcgcaacaatcttttttaaaataagaaagaaaatacaataacttgccgtatttgtgcattccaaagaaactacaggagtgtgagctggcacagccaatgctaaatgtattccacatggttattagccagtaagttttgaaaaagggagagaaaatctgacacttagggtttctaaatgaatacagtgcactacattcactctcagttatgattctggatgcacagtttaatatgattaaaacttacagaactgcacagagcctaatgtcaggatgtttccatgtccctcaacatcatatgaatatcccaggtcaaatataacatgacactaaaggtctggaagcaaagtagatgacctgaaactgtgtattttaacagatctcattgactcttcttttcaatgactgtgggacaaacacagcagtttgaatagtaacaatggctgttaaggtaaagcttaatcccaaatgtgtaagcataaaactacattcttcaaaaagattttagagtatattttattaaatcctgaaatgcatgtcctggtaaatttctatataaatttgatttacaaattccagtgaaaatgtgccacagctggcagaataaattactgcaataaatcattattaaataactgtaaatctttgtaatgacataaagcctaacttttaaaagtatgcagaagtcaacatttggttcaagaaaagcactcttcacacgggaaagcaaattacaaaacttatcatgccaacactacaatgtgattcagtgactaaacagggaaataaaattcacataaatagtgcttaaatctacagtggagttgtgttcactattgcatcaaaacaaattgtatggcaaggggtaaacagactcaagtttttaacagtatcaatcacactgccaacgggtaagtcttacatgtacagctggatccaatattttgttagacaataaaagcatattccaggtatcaatcagcaagcccagtatgtcccttctctgaagcttcataaatatttcttcaaaataatctatttttccaccaccaccctctcttccatatagaacaccatcctacttcaaaataaactttaaaaatatctatacagagttctattctttttgatgtggagcagatgggtagttacagtaatccatactttagatatcacttgaagtgaatcacactgaatgtctatgccttactgagcgctgtgaagcctccatatgccaaagtgcagacacttggtacttgtgtcacaaccaatggggtccatggctccagcccagatgggctccagcaaagcaagaagcctcagagtgctcgcttatagcctgtaattgctgcctctgtctctcagaaagggtaaattattaaccgacactctcagaactgtctaagataaactcattagaactggtggtctacagaatatttcacactgccagttggtaaaatctttgtccaaggcatcactgcctacctttttatgtatttatcttcagctcacagtcagtcatcacaaaatgaaatgtccctgagcgccatttctacctattttcctacttgccaaaccccagagttccctaaagtgtctctggataagaacctttgcctcctccaccaagtgcagaatttatcagtacatgagtctgattcagaaaagttgccccaacccaacaaacttgcaaactgacctgtccgatataataaagagcaaaggtcactgctattttaatccagatctaaatgttcttgtaaatacaaatgggagggtctttcccccaccccatatttcattttccaattataggttcagttatagattcaaatagtcatttttttttcttttttcttgagacagagtctcgctctgttgctcaggctgtagtgcagtggcacaatctcgactcactacaagctccacctcccaggttcaagcgattctcctgcctcagcctcctgagtagctgggattatagccacccaccaccatgcccagctaatatttgtaatttcagtagagatggggtttcaccatcttggccaggctgctctcgaactcctcacctcaggtgatctgcctgcctcagcctcccaaagtgctgggattagaggtgtgagccaccgcgcccggccccagccatcttgttttcaatatgcagcaactgattcactaagatcattattaaatgcatccacccaagaagcacttgagggccacagtcagctatttcttcccaacaagatacttcccccttcacctccacttccaatccacacaaagccattctccacatattgcccacacttatgggagagcaaagcatctgtgctgtggcctcaaaacctgacacattccagaccaaataaatacaccagaaaaaggatacctgactctgtaaaaaggtataaacatctagaagttatgtgtggaaataactgaaaatatttccaaataagcaacagttcaaaaagagagagcaagagagcatgagaagacacatggcctcaaatggagggaggcagaagcacactgggtgcaggaaaacagtccacaggagacccaggggactgaagagaatgcataatcagtgaacaaaaggaaaggaggctgtggggggacaccacctcagaacataccctattaacagaaaagggcaggagtctagattacaagagtaggtgatgtaaacttttagctacattatccaggaaaagtagtcaaaagatgaaagtgtcgaccactgctgcgcttaaccattagggtaatatcactatgctaactatgcaattatatgacaaaagagatgacccccccatcctttcttccccatcccaccgttccatgtccctaagctacccagtacattcccagggttcagtactacctgttgacggctagtaaatgtctatatttagcctagatctcccttctccactatgaatgcactcctgtcatttccggggcagtgtctaatagaaacttcaaacttgacatcttcccaagtgtctgtcttattactcctcaaatctgctcctcctccagcgctgcctacctcagtaaatggcaccatctgctattgagggcttggaaaatgattttctccatttataaaagaccattttatccttctccgcttttcttaggagtgtttccttggagacattgtgaatctgagtccttactctaacctttggaacagagataaatctctctaaggattaagttcagtctccagtttttacaatgtagagatacgtctaagtcatgtgccaaaccaacgctagatatgtgaaaaacaaccctctgggattaactcaggtgtctctcatgagatgtacagaagactatcaaaagggacaaccctttctttgtctctcaaagggatgagaagttattaagaatatactttcttctgctgttctgtattaactgtgattttgtccccaacttcatagccacttttgagatatcttacatacctgcaaaatctttttatgcctactcaataataaattatattctctctctcttcgctgtggataatatgtcttttttgttggcatgattattttatttccccaactacctctccctgcctctctgacaccccacatgcagtcaacctccaaatctttctagtttatctcctaactgtctctggatctatcctccattcctctctctattactctggtacagactctcatattttgacagctgaaatagcctcctacctcagcttcttggagtcacctttttctcccttccaatacattcttcaaattgcagctgaggttccaaaatcatttaagaggaccctgtaagatttgatctctgccaacctaaccatcttatcaccttctcacagtgatctcagattttctctgctccagacattctttctttgctttaaagcttttttctttcctcattcctgaacctctccccttgccttcagaaatggtttcttaaactagacctaggctgggcacaggggctcacgcctataatcccagcactttgggaggctgaggcggggaaatcacaaggtcaggagatcaaaaatatcctggctaacacagtgaaactctgtctctactaaaaatacaaaaaaaattaaccgggcatggtggcaggtgcctgtagtcccagctactcgggaggctgaggcaggagaatggcctgaacccgggaggtggagcttgcagtgagccaagatcacaccaatgcactccagcctgggcaacacagcgagactctgtctcaaaaaaaaaaaaaaaaaaatagacccaagaaggtaactacctattcctaaagtgccctgtactactttccaacactagtaattacttaatttctttcttatgggtcaataagcaccatgatggcagggctctttgaacctatatccccagtgcctagtacagacagactcaataaatacttctgattgaatgttccaacatactagccatgaaagtagacaagcagcttaaaagctatttaaaagcatgtagatttacctaatttattatacgtatttacagtgatcttaaatctcttgctatatggtacaacatcttgaatcctgtcattttctaactaaataggaaacgattatctgaagaatcagaactccccatcaccactactttctggctaccatcagtgtccagcttatcaagacagagataaactcactcatgccctggcgcttgagtccaataaacccttgagcaatttcttgacaactgtcgaacatgacagaaatcgaaatgtgagaaatatctgtcaaaagtttggagatacttcttaagacctaacacacttacattcctacatttccttaagcccctttctcaaaactccattgttaacaacaacattaacaatagctaatgaaaatgttgactatgtaattttactgtttccaacaattattgactgcctactatattcctggtacaatggtagcaaagcaacccttgattttaaaaagaaaaaaaaaaagcatacttgcaaggtcgcatcaagttcgttctgttatttaaaagcaaaattaattgtaacaatccattataataaagtcttataaattacaattttatatgcaagcaaatagctttttgttcctttacagtatttagagagtttggtgataattttattcaagaaattacaaacacaaagcaaggtatattagttttctatgtctaccctaaaaaattaccactaatttagtggcttaaaacacacagttcttatcttacagttatattggtcagaagcctgacaggtctcactgggctaaagtcaagatatcagcagggctgccatccatttaagagactcaaaagcagaatctgcttccttgtatttctcagcttctatccgccaccagcattccttagcttagggcccagatgctccatcttcaaagccagcaatgttagagctctcttactattcttccatggtcatctctctctgaccacagctgggaaaagttctcagcttttaatgattcatgtgattagactgggtccacctagaaaatccaggaatatctccctcatctcaaggtccttaacattagccgcgtttgcaaagtcccttgtctttcctttttttttagatggagtttcactctgtcgcccaggctggagtgcagtggtgccatcttgactcactgcaacctctgcctccaagattctcctgcctcagcttcccaagtagctgggactacaggtgcacaccaccacacccggctcctttttgtatttgtagtagagacagggtttcaccgtattggccaggcagctctcaaactcttgacctcatgatctgtccacctcggcctcccaaggtgctgagattacgggcatgagccacagcgcccagcccaaagtcccatttcttatgtaagatatatattcacaagttcttaaaagttggtcatgcttgggtggccattattctattgaccgcacaagacatacaaaaatgttaggttagcattctacactgagaattaatagcatttctaattatctggtatttaaaaatctgccaatttaatataaggctaaggcacaatatatccatcaatcttattatcacaatcaaaaatctttgaagaatcaactggttgtatttatactcacagatgtaaaattaaatcaaccttttaaaaatattgtttaaattatctttcatttgaatgggaaaagtattctacggtcaaagttcatgtttttgttataaacacagattcctaaggaaatttgttctgatttttagcagtaataaattccaggaaactaattcatttaaagtaggttataacacttaacttcatggtaatcattttcagttcacaccaaaaaccaacgtacagaaatggattacaagttactactccaacagctggctataatctcacacttctataataagaaagatatgatttcatacaaaaaatcgaggcaattggaattgaggcttaattcactaattgcttttactatttttgtactttgttatgataagggtctttttccacagaagtcaaggaccacaaattaattttgttttattcaagaacagtatgttttctgtatagatattagagaggactttaatggaaagtatggtaacttttaagatttcaggaggaggaaaaccaccaaatatattttccttaatttttttttacactgaaatcttattgtcttgatagaagtttataaactgaaatgaaaattaacactatctatatgactcagtgttaaatccctcaaaatacataggaagaaaaaaggaatactaaacatagcttgaaaacaaatcaagagaacaatcattcttaaccatgccatttatatataattccattttattggtatctattttaaatctgtgaaggcattctacaatcacaactgaaggtagaagtcacataaatatcatagaatacctcaatttttggagacataaactattttttttttttttttgacacagagtctcgctctgtcgccctgactagagtgtagtggcaccatcccggctcactgcctgctccgcctcccgggttcacaccattctcttgcctcagcctcccgagtagctgggactacaggcacctgccaccacgcccggctaattttttgtattttcagtagagacggggtttcaccgcattagccaggacggtctggatttcctgacctcgtgatccgcccacctcggcctcccaaagtgctgggattacaggcgtgagccaccgcgcggggccagagacagaaactcttacgagctaagtattttctgaattttatttgcagtgagaatgtataggaaatagctataatgatacttccatgggggaaggcaggacaggagagggtcctatcaaagaccatctaagtataccaccaagtaatcagcttcattttaaaactaagccaaaaaagacaaattcaatgtaacctcctcaaggtgagtagtatttttcaaaataccactgctgttcagcaactctcagaaaaatgtacccacactattgggtggaatataaatagctaagtcatttaataatttgtgcatccacatattgggtctaaatcatgcattttcaataggggtgaaaaaatttagatattacaacggtttatggtcctttaaagttcaaccctgccagacaaaatcttattcttaggatgtaatgagggcctggctgggaggaggttggataaaatgcctaaaaaggctccttaggccctgatagtgaaaaaaaggtccaatccaggataaatccaagcctggttagcaactacagggatatgaataccaggagatccccagtaatctgcgttaagtccatctaatcctacagccaacacctccactggttctaaggcatctctaaggataacccagttggaccatgtaagaaatcaacaaaaatcatcatagtccaatgagtcatttgtgaactcaccaaaggtgtatctaaccacagagaaggtggcaagggaaattaatttaaattgtgtttgaattctaatgaacagaaaacaaagttgctgacaggaaatttggggaggagagggaaacaggggaaaaaataatgagtgctgcagcatttctttaaaaaaagaaagaaaaaagaaaagtaggtaacaatgaaccaagaagttctgttatcccttatccccacttaagaattttcagggccaggtgcaatggctcacacctgtaatcccagctctttgggaggctaaggcaggaggattgtttgagcccaagagttcaagaccagcctgtaaaacacagagcggccccgtctctacaaaaaaaaaaatacaaaaattagctgggagtggtggcacatgcctgtggtcccagctacttgggaggctaaggcaggaagctcacttgagcctgggaggttaaggttgcagtgagccatgattgtgccactgcactccagcctggcagacagagtaagaccgtctcaaaacaaaaaacaacaacaacaacaaagttttcacatgtggtatgaaaagatgaaaaaatatttctggtatagaggtagcaatagttagctgcaatttcagaggtaattccacttgttttactcttgatgctgaaaaactaatattatacctatagcaaacatacgtctctgattttccacaacaatcccaatttcatataattgtattcttcctcttcaagaaactgattctaaaatacaaaactatgatataatctaagatttttcaaacaaacaaatcaataccagaaaatccattgttagactcttatgcttttgcggggagagggagtcagaaaagcaaaccattctatttaatttataaagcaacatactcgtaagttcaggattctagttatggaagctggaaaaccaaataataaatgatggatgtctttaccaatttatatttatttatggcttaattattcagtactcataattattccagggctcccttaaataatatttttgatgaacagaaataacttacatttcagaccatgacactcaactgtcttaagttccacctaactacaaaggcccatgtttgaggaattagtgctctgtagctgatgaaattgaaaatgctaccaagttacatgtaaatggtggagcagagtaatcagtccacaaataaggtaacagaagtaaaatttatcatgatactcaaagtaccaaaaattaaaaagaatgaacatggaaagtagcaaaactttttagccaagaagaaccaatagagtcaccaacatcagcttcagaatgttaagataaaggacagggtaggttactttagaatagtgatatttgtgagatcaaaagaacccatgctccaggaagcaaactcttcactctggaaggtgagcgttgatcctctattttttcatggacatcatcaagttggtgccatccaaggccatatggaagtacctcaccttctggaattttttatgaggtgcaagggaggaagtatttgagatgaaatgccagaaggggctgatgtaggaaatacaatcatctcgtacaaaatgcctttgaacactatccaaagacatccagagatctttacccaccctacccccaaatgtttttctctttcctagtaaaacagtatttcgaaaaaacaaagaaaatgaaagttgcaagtgggaatgaatcaaagcccacaatccacttcaaaacccctggatgtgcacattacagaaaggggagatcagtatccagagaggcacaatgaacttcccactttaggagacccaacaccaacagcagttcccaggaaataacacgaagtagactacagctaccccatttgtctcaattttctattttcatttttgtgttcctggttttgctatttgttctccaaagtaacagacagagacaacgaggaacagagcctggcttcaagaagaaagagaaagataacctgaccgcttaaggtcctctgtcaacttctggattccacagaacatattctgagatgactgtttagcattaaaaagtgccccctttgtatacagcactgtaataaaataacagtaatgataacaacaatgaagaggccttgcatctagtgccttataccttacttaaagtgctttaatgactttaatggattgaagcatccctatgagatcaaaggcagatagatactatcatttccagtgtacataatagaaaatcaaggaagaaaggttaagtgacttgaccaagactcacttatcaatacagtgatgttctgatcacagttaaggggctgctagtccctgtgctgcttagatggtcactcagctcaacctgcagttgaacccaaaacggctctctagctgagaggttatggtgataagggctttagaaaaaagatccatttaaaccttgttagcaaagggctccagagaatgtcagaagataaatttatttttatagagagtaattccgttcccctccatttttgtggtccatacccccacaaaatagtacaatgcaaaatcaccttcagggtcaggcatggtggctcacacgtatattcccagcatttttggaggccaagacaggagtatcgcctgagcccaagagttcatgaccagcctgggaaacatgacaaaaccccatctctacaaaaaatcaaaaacttagccggccatagtgacatgcacctgtggtcccagctacatgggaagctgaggcagaaggatcacttgagcccaggaggttgaggctgcagtgagctgtgttcacaccactgcactccagcctgagtgacagagcaagaccctgtctcaaaaaaacaaaaaaaaaccatcatcaccttcagatgatagtgattttatatgaagttaggaaacaaataaaacatacagcatgaaggggtcaagagggagaacccatcattcaggtcttctccaggctagtggtgagtggcagaaaactacatagcatgttactttccaatgataaaatctaaccttcctacatcccattcattctgctaaaaatgaacacaacacaccccgcaaaagaatgctcaagtaccatgtcacaaagggtggcaacatcatctttaaccaacacctagtgtttgaaaactacagagctatatatgcactggtgtccaccaggccctcctgctgaacactaatcactccctaccggaagactatagcaagtggggggaaaactaatcctaacacaaagtcccttaatgtccctttactacctatttatttgagttaccaagtatgtgacgagaattaaaataagagctgggattggttcctaataaaagttaacattgctctctctttcccacccacacaaaagtaattctgtttaggaactttaatttttttggccccaacccacccttggggtgtgtagctcactcactgccagtaattgcttccatacaattctgtgttttaaaacatgtttgcatacttatgatgatacatgacatttatattacatttgaaactccaaacaggcataaagattgtattttctgcattaagaaacagagtctatgcacggcataccaaagtagccactagaaaaaaagtgacctcaatttcatttttattttcaaatctgtcaaattgttggcctcctgaactttaaaaaaattaagtggaaacacaaactcattcatctggtaagtaacccaacctaaaaatctgtgacaagagaccatgagtatatatcctgtcatgtacccaaattaatattacccaagtcaatatgccataaattgtattggttaataatcattttacttaaggcaatttcattggcccttttacaagactcaccttaaatgtaacaaaaatagaaaacatataataattatagctcacatttcctttcttgaaactactaatataacattttaacccatgtactagctcattaatgtggaattatacaaattgacataactttacttatttgtctgttttttttttaataagaagcaattatctttctactttaaaaatcaaattttaagatttggtagctaaatttgataaactgaatttgttcttcacaataagcttatggtcaatgaaagaactcaaaattatcccaaaaataaatgagagggagggaaagaaggagggaaggagggaggagggatggggaagaagggaaggaagaaaaaagaaggagagagagaacatcttctgtaaggatacgaaacccgctgtggcatatactctgattttttggaaggttatatcttccatcttggctcttggtttaggaagaagtaacaactctttagagtcagacaagggatgaagcagctaaggacggacgtttgtactatccacactctatcgtacacaaatatttagtattctagacccatttgagggatttttgtctctaatatggtaaacatacacaaagagacagtcttattaggtaaaaactaaagcaattagaggatgttttctggggtcacaatgtaattttatgaattgaaaatgtaatcagattttattctggctaagactcctaaaatgcaataataatttgcttaaaatatacacataagatttaagatctattttggagaagcaaaaatccacccctgaaatgaagggataaaagctaaattttggtttctaaacagatggaaacaatattactcaatattattaaatctgttattattaacattttagtcaaaactagtgccttttaaatagaaatatttgactttagaaaagcagaaataatttgactttagaaaagctgaaatatgttaggtaatgaaatgcacagagtcacagaatcaccacctggtcccctccaaagctaaattttaaaaccaaccccaaactcttttggtaaaagtaacaggtttttttccatgggctataatcagtcatgaatgatgccttaattaaagctgggcaatgaaactgtgtattaagcttagtatgtgaagtcaaaaaacttacttcttagcacaacagggcactctcgtaattttttttttttttttttttctgagacggagtctagctctgtcgcccaggctggagtgcagtggcacgatctcggctcactgcaagctctgcctcccgggttcacgccattctcctgcctcagcctccggagtagctgggactacaggcgctcgccaccacgcctggctaatttttttgtatttttagtagagacgggatttcaccgtgttagccaggatgttctcgatctcctgacctcgtgatccgcccgccttggcctcccaaagtgctgggattacaggcgtgagccaccgcgcccggcactcataatttcttaagtgtaccctgttaggtctccatattagcagagatgtaaacgatatcacttttcaaccttaactgtgaatttcttcacttttagtgctttctgtctcaactttaatgtgcttttaatgtagtttttcctgtgtgatatatcatacttatctctgcaaccatccatcactgtttcctttaattgaggttaatttctttcaacttgggggaaggtgggagggatgaggggaatcctcattctgcagctctgaacacgaagagcattcgcagctgctgattttttaatcatgaggactgattttcaggatgcttaaattcctcaaatctgccccactgccctccaatctggacctaaatcaacaatctactgggatgggaacccagttcccacccagaaccacttaatgaaaaatttctatctaactaaaatccctccagctgcaatctaagtccttttgtttattttcactcaaatggctaacagctggtactaccttccatgcaaaataatttcatgtgtttgaaaacagtgattaactcataccttggtctttacttctccagaccacaaaaattagttcatttctcaaatcttttaaacatcttctacttttacctctgggctacaggtcctgttggagtttggaatcatcaaatggccagaaataagtgaaatgaattaaatggtttgggaaggttactttgcttttcctgaagagtctagtgtaggggctttagagtgggctctcacaaaaagctggctggaggttgccctccccacacaaaaaaacaactcccctacccagttttatggagtaaagatgaaccaaagagaggaaagagggacttaacaagtgtaaatacagagcctaacaatttttaaagtcaccattaagaagagactggacaaagggttttgacatgccaatcactatctggctaccttacatggcatagtctacctaagcatctctgaacattatatacttcattcccaaaggagaatctaggaagatcgtaagagtgagggagagggatgaaatgtacagccaacgtcagcccagaaagccagatggtagactctctccatattatagaccagaagcaaccagtcaattaaatctcaagtattcatcaagtgcccaacactcagtaggcatgcaatgagtattaaactgaaatactggcaggctggggagaaccttctcagtttgggcagtcctcagtactgggataaaactggctgggggtcagtgctcagagagacacaaggaaacaattacatacaatgtgaaaggcccctaagggcggtacatgctaagggatatgggagagaaaactcaaatcaggctagtaaattaggccagggaggattttttttgtagagctgagcctttccggagatcaatgctgaggacagaaatggcttcagagtagagtcagcctgtatacagagttgagggagattagaagccaaatgaggcactggggaaaaagtatgagagggttgtatgctctgccaagaggttcatatattatctatagacagtgtaaagccaaaatttgctgtgttttatttcaaatttttattattgaagttttcaaacatgtattatacaaacgtaaacagtataatagcccctctgtgagtctcactacctaacttcaacaattatcagcacatggtcagtcttgtttcacctctcccaaaatcccctttagctctctcctccactggataattttaaagaaaatccaaaacatgacattatttcactagtgaatacttcagtagctatcaaagacttttaagatccgacatgctcaaatctatcagggcaagaagtgaagaggcaggttatgcaatttttttttttttttttttagatgaagttttgttctttcacccaggctggagtgaagtggcacaatcttggctcactgcaacctccacctcctgggttcaagcgattcttctgcctcagtctctcgagtagctgggattataggcacccaccaccacgcctggctaatttttgtatttttagtaaagtcggggtttcacaatgttggctaggctggtcttaaactcctgacctcacgtgatccacccacctcagcgtcccaaagtgctaggattacaggcgtgaaccaccatgacaggccagtgtatgcaattcagacacagaagtcagtaagagccaccaagtagtggcagtgaaggtagggaagttatgagagatgccaaggaatctttccttaaatcaatcttcctattcagaagatggtgagaaaacgggagtgttacaagaaactgaggcaaaagggatttggataatggcaacagagacatttaacaagaattggaaataaggaaaaaatgcagagttggggagatgtgtttagtttgggatatgttcaatttgatagaccaaatgcacatgttagtagaataaatgaaaatgctaggcaaagagatgaaagagaaagagctgatccagagaagagaatgaggggggtggaatccaacctaactcagtaagtatttgaaaacagacaagcagctgggataggtaccagagagacagagaagtggtccctaccctcaaagaacttttagtctaattggagaaacagaaaaactgcctacataaacaaatgcaaaattaggataagtgcttaaaaagacaatttatcaaaagcgatatatgacttgaaataatggagactagactaagatcttattaaatcaagcgttgaatttaaacagggttcagaaacgagagaaagacagaaagcagagcaggaaaccttaagaaacagacaaatggcgcagacagtggcaggagaatagaagaggggaagaagaagctgagaagtaggtagggggcggaacttccaggtttctgacttccagagacctgaaatggggaacaatggaagaggattaggcaacataaaagaaagcaacgggtcttctgtaagaattacaaataggaccctggaaaagcatagtgcctgctgaggctgcagcttaaacttgaagtcaaagttcctgggccttaacaactatatatgattcagacatatagcacaaaactaagtgcgctttttgtttaagtgtcttgccatgcctacaggtctgcaggcttcatgagcagggaccacgtctgttcgtgtcactgctgtactggaagttctagcacagtgcctagcataaaataggtgtctaataaataacagagacattatctcatttactcctcacaacaacaggttaaagaagaaggatcattctctcccattttactgacagggaaaatgccactcagtcagtgaaaagactaacagtgtcacctggttaataagtgatgggggtcacgtgacaggaccccaaatcagggacggaatcattgcacaggcatgagagccaacggaaaggagagctcagggaggccatgcagcttaaaggatgtgatgtcaaaggccacggacctgggaatgagaccaggcttggatctaaaaatcccagtgctgcctgccccttactagtcacaccgcttcctcatctacaaaatgaggtaagtagtctccaagtcgccagcttaatgtaaagagcaaatgatgatggatgtaaagcatctagcagaatgcctggcacacaataagcactggataacagcaagctctgccaccacttacaagattcatgtgggtggagcttgtcattgaagcttgcaaacgtgagaaaaccctgatgctgtgaagtatagaccaacctgtggcattttcaggctctaagtgggtgctccaggataagtggagccctccggaattacagagaaatttcccaggccttgggaaatttacacaaaccctatggggaggagaagctgtatacctaacctacagcctacggttttgctcaatgaattacttgacccaaaatgaatgtaaggcccagcagtcaccgccagaaacaaggaggtcttttcttcctaaagcagttcaacagcagaggaaactaacatagtcccatggctcaatgctaacctggaaggtatgggccaaatctcagaatgcgaggcactgaacacccagagatacaggagagttgacagtggatgctcatccactgccaccctaagatcagggccaaccctgtgtagtcacagatatgggctgattgtgctctttctattcaggtaaaacagagatggtggttatgaaaaacctctccccaaagctcattcaccttagaaaaatagtaagatacttcttaaataattcactgacaatcagaaggtaaattactgacatcgacatctctaaattaacttggtctttggcttaagaactcaattgacaggcttctgaagccagaaaggaaccaaaatgacccatatgaatactggagcaactacttccaaatcaggagtttacccacaatgaccatggtaaccaatcacccaggggctgtttcacctgagaagttctacatctaacagcacacctctatttttcaaaaaccctaccctcaagtcattcaagaattttttttttttttccagcatgggcaacatggtaaaaccccacctctacaaaaaatacaaaaattagccaggcatggtagtgcacgcctgtagagccagctactcaggggctgaggtgggagaatcgcttgaaccccaggaggtgaaggctgcagtgagccaagatagcgagatcatgccactgcactccagcctcagcgacaaagcaagaccctgtcacaaaaagaaaagaaaagggctgggctcggtggctcacgcctataatcccagcagtttgggagtccgaggcaggtggattacttgaggccaggcgttcatgaccagcctggccaacatggcgaaacccctctctactaaaaatacaaaattagctgagcatggtgccgcatgcctgtaatcccagctactcaggaggctaaggcacaagaatcgcttgaacccaggagacagaggttgcagcgagccaagatcacactactgctctccagcctgggtgacagagcgagactctgtcccccaaaaaaagaattcttagcaaggatacctaatatggagtggaatgtgctatatctgtcctcaggacaagaggtggcactgagtctaacagacgtgaaaaaaggtatcaatttgctgagactgataggcttacaaccctctatacttaaaacaaggtttttaacacaagctacttcagaaataataaatctttcaacagattgtgtaggacaatgtgttcccaggtatgtgagatcaaaacttggctcttactgtctgcaatcccagaagttcattaaatactgctatatggcacccaaggtttggttttaagatatgtgttcattttcatccaagaggcagctacaagtataggcagagtatgtgtcacagttggcttgcctagcatatcctgcatgaatagtcagcaaaaaagataagacgtttatagattttaaaagcccaccaacagcaatacatgaactataatgacaagacaaagcctcactccaaaggacattcaacttgataaaggtgtcactattcacagttacactcttaccatttatattttttctcataaaagaatgtatttaacactttcttcaattttccctagaaaggcatcttttgctaaatgacagataaactccgccaagaaattcaagactgattttattaccctcacaaccctaatcctctataaagaggcaacatttccaacattgaaatattttagcaagcacagttttaagttaaagtagtatctttacagttcatggtggggggaggatggcagggactataaatggaaaaagaatttttaaatccctgttgcattatctaccagatgtaagtgaataataactaatatgtctgcagcctcagccttaatcttaaaacaaatgatagtattcaaatacaatattttacacatgcagactgataacaggtttttcctttatttcttgaagagtctgtgaaagacacaatacaaagtacaatgtatttaatgaaaggtttccaggctgatttccctacaggttattttctttcttttctctggaacccacacacggggtatactgcagggaccaggggtgtatataaaaataaactgtgagccagtatcagagttgatacccttctcctacaggggcaagtgaattattagatctgtgtcatgagtgtttttttttaatatgccattgttcccacttgagcacattaaattttccatatccacttttaaaccaatataacatttttttccttgttcataatgttcacgctgtacattaacaggcagaaaatccaatagcttaagtcatcatatagtagttatatgtaaagcttagtagatgaaaaccttttgcattttccccctctttgaactgatactatatgaagttggctaaaacctagggaaaaaaaacctcacacctcatgggaaactgtactaatttttttttgtcttttatgattgatcacaaatccattttgaacattacacatttttttaaagtttattataactggttcaacgtcttcaagcccaacaaattgaaggtgctggaatcttttggtctggaggatgtgtttgccaattatttttgcactagtgcacataaacagggaagactggatcttaggtaggagttatacattcccgtacaaaataattgtatattctatgaagactgattctttttctggagaaacatacaacaacacaagggaaatcttgtactagcagcctaactgaagtggcaagatacaatattagaaaaacagagctactttcattactgtgatgctgtgtgtcagaatgtctctccttaatgaacctgtttgcaataagactccgggtgcaaagaggctatttagagagactactgtgtctatagtgagtccttcaaatatcttcccactattagacatgccgcattgaccaattctgtcctgattgctgttctttttactatcaagggacactcttgcccagacagacggatggatcagacactgcagttcataaaatgtttgcactgtacacacacatgcactatggtacaagctactgaactccagatcatacagtgagttgaatgtggcagtgtcatatgaaggcttatgactttgcaatatcaatgaaaggatttaggttaaactttgctcatcctgcctgcctgtcactctcaacaaaaagccttttttcccctctctctttcagtgtatgtccattcccactgcttacatggaacacttcaggcaaatcttttcagcgtcacaaggttttctcgttctgttgagatttttctcctaattgctgacaagaaaagaggactacacgtcatgcaatcagaaaaaaaaaaaaaaaaggtgagggacagtgcaataataataattttaaaatggtccaaaagacttcctaaaaagatgtgaaattccaactcacattgacagccgctgagataaaggggcttgtcgctacagtaaatgaagcatcagcaacctttttaccaagtcttaacatgagagcccaaggtgcttggaggaaactttccgttcatcttacactgtgtatggtcttatcagctgctgggtgttgctgtagcctcacctttcatacacctacatgccaaatgacctctacaaaagcctttttccctttgcgcattttctaacagtacgtcctttctatttgaatacaaataatgtgcttgccaacaagttgcagatggtattatcccacgcccccaatctcagctgtcatatagaaaaaacttcaagcccaaaggtccaaattgacagtatgtttttttgttttgttttgttttgttttgtttttaaagacacagtctcactctattgcccaggctggagtacagcgtcacaatctcagatcactgcaacctttgtctcccaggctcaagggagtctcatgccttatcctcccaagtaggtgagattacaggtacccgccaccacacccagctaatttttttatttttagtagagacagggtttcaccatattggccaggctggtctcgaacgcctgacctcgagtgatcggccccacctcagcctcccaaagtgctgggattacagtcgtgagccaccgtgtccggcctaaattgccagtatactaataagtacaactactattcgttacatctgataaggaaccagaactgcacatcgaactgaatctggatctgatgaaccaaatgcatccaatgacagtttcgattccatttaaaaatttctgtaaccacctccttttttctgggctcaaccttacattctatcaggcctgacatacagaccatagcttgtgctgtagctcaggcttcgaaagacatttggaatatctatgatttcaatgtttatttcctcatccaacttttaaatctccattgtgataaaacttacaaataaggcttttattaaattactctgaacatttactaaaaacatacaagcatttcttaatcaagatatttgcagtattgtaagcctgtttaaacatactgaatatctgactacagatttaggagttaaagggtccagagagatctggtagcagtcgccatttttctacaaaaaaactaaggctacaaaatatttaaggaaacctgttttgggctgaacaacccaggaccctgagtgctttaagcctctggatgccttatctgctggcctatcccacaaaagactgtatatctgttatccagtgaccctcttgtattttgccaatgaagcgttttttatttgtttttgcttttactaaaatatgctcagttatatctgtcatgtacaacagtaaagagaaaaaatacatgtaattacaaggaatacagataatgcaaacattatttctaggttcctttagaacagttgttttcaaagtagtgtctcacaagtagcagcaacagcatcatccaggaacttgccaggaatgcaaattatcagaccctgaccactacagaatcaaaagacctgggggtaggggcccagcaatctgtgattacacaagacaagcaagtgatactgatgcatgctcaagtttaatcgctttttgagattcatggcatcttttgagatttatattttatttataagtaaatgaagaatgtcccctataaactctaatttgggataagaagagcaatatacagaagtagctgctggctccacagtgaaggagtccataccactgtttccttaaacactgatttcgttattaaaaaaaaaaaaactcccatgatttcttcatgttgtatgtgtgctagaattaaaactaaaaatgatttttcagaaacactacagtccctggtcaaatgtgtgaggtaaccagggtatcagtttcattcagtgacagcccttactcttcaagagcaatagcttctgagcagaggacttaatactcatcaagagtatctgctcaaggaatggaaagaccttgatcccagtgggcctgaactttcagttcctctacttccagcctggtctgctggtccacgctttggtcttctaggatttcttcaatggatacttgctggaggggtgtgtcattctcattttccaagtccaaattgatcaatacttcttaagtctattaagtgtccttccatcttgaagcaggaccaagtattttttgtcaatgtcctcaatgaggctggtggtgccgggcctccacaaactgtagtccttgcaacacgaaggctgcagaggagctcagcaatcagttcattttgaactgaaataatcctgcaatgtacagcggcggtgggccactgtgtccaaaaccaaaacctacctgaccaacgcagctgctgcctcagcaggactgagaccagaagtggaaccccgaccaggtcaggcacttctacgctgactttcagccacggggacctgcaggaaactcctccgtattacctacccctcaagtttataactatggctttagaatacacaccatgatttacttattcatatttttttaagagggagtttcgctcttgtcgcccaggctggagtgcaatggaaccatctcgggctcactgcaaccttcgcctcctgggttcaagcgattctcctctctcagtctcccaagtagctgggattacaggagcccaccaccacgccctgctatttttgtatttttagtagagacggggtttcaccatgttgcccaggctggtctcgaacctctgagctcaggcaagctgcccacctcagcctccaaaagtgctaggattacaggggtgacccacagcgcccagccaccttgatttatttaaattcagattaaaattatttaaaatggctagtactccttaaggatataatcaactagctgtaggcaagaaacagacacaaaggaaagaaaaacagtcctggatttaaaataacttcagaaatatcccaatttagagcaacagccaattaattgtaaagacgtaattttaattgtaatgcataatacaaaccactccactaattctgttatgtgaaagaaagcaagcactctctttcagaataatttaaaaaattaaacacttaagtaattccaaatttgaggtgatatgatgggcaacacgaaggaaacaaattaatgaagttaataataagggtcaattgaaagaaacgaatatgaaggaatcattctttaaaagataggacagtggcagccaggcgtggtggctcacatctgtaatcccagcactttgggagtccaaggtgggcggatcacctgaggtcaggagttcgagaccagcctggtcaacatggcaaaaccccatctctactaaaaaaacaaaaattagctgggcatggtggcacacgcctgtaatcccagctactcagtaggttgaggcaagagaatcacttgaacctaggaggcggaggttgcagtgagccgagatggcgccactacactccagcctgggcgacagagtgagactcctgtctcaaaaaaaataattaattaataaattaaaaaataaaagtaaataaataaataaataaacgataggacagtggtttggggcagacaaaggcaagaagagtcttagccaaggtaaatggatgtgggggtatgaacacattagaaaactagtaccagatgaagagcaaaaaggagaacagggacattctgccacatgagttgtaatattcaaaagacctgtgaaaaacatgaggagcaaatttgaattgaatttatcatcaaacctcagggaaattatttcataagaactgttaggggctggacacggtggctcacgcctgtaatcccagcactttaggaggccgaggcaggcagatcacgaggtcaggagatcgagaccatcctggcttacacagtgaaaccccgtctccactaaaaatacaaaaaaattaaccaggcatggtggcgggtgcctgtagtcccagctactcgggaggctgaggcaagagaatgacgtgaacccgggaggcggagcttgcagtgagcggagattgcaccactgcattccagccttggcgacagggcaagactccatctcaaaaaaaaaaaaaaaaagaactgttaggatgtaaaaagcatgtcagaatcacgcatgactgtaaaatcaaagcaagcactgtttataataacaaaaaattggatacaacctaaatgtcctcccaaagagaagtggtgacaataagtatggtactcccatacaatggaattctctgagaccggaaaaaaattatatacattccatgttactaaacactgaaaatatctatactggcaatgagaaaacagcaattaaacaaaacacatactattatctaacttctacttccaaagccacactaacatatatgtatgtagatgtgtatagaataaagactagaaaagtataaactagaatggccacagtaggtgactaaatggcaaatgaattttattttctcctccccttttctctattttctgcattttcctattttataaatgaaaaacaatgactctcataatgaggaaactgtaaagatacatacacacaaatactacaattactctcataatgaggatattgtaaagatacatacacacaaatactttctttttaaggcaataaatgatgttctctattggcagagacccaaaggagtgctgctgcctggcagaggtattagagcagtgacaaaattccagagtcttcatgaaaacaggattctgaaacaaagacacaaactttggaagaaaaaacccccaaactaccaacaatgatcataatatatataaatccttcttttcagccaaaaaaacatgatgacctaagccacttcattcaaaacaataatccaaaaaagaaacagaaaggacaatctattaagcacatattatgtgtcagatactttcacattatttctctttcacaacaacttgcaaggtagcatctgtattttgcagataaaaggctcaaaaggaacaagcacacttctagtgcacattggaccgcagagcctatacctagtttaccagacttccaagcctgagctctttccactgcacaaggcttcaaacgagatccttaatgcatagttctcaaagtggtataagctgaaatctcagatgcccaaacaacttcagaaaggactccattatcctctgttaaatacaaaacaagtattaaagaataggagggcagaggaaggggaaaggcagcaagggtctgatgtgaaggcagccaagcaggttatgttaaagacttctgacccctaacataaaacgatatttttagaaatgctccttttgccttcttttggggatggcagtggtaatgcaatgttcaaacaaaagatgttaattagatgtcagactcctgcctgtaatcccagtactttgggaggccaaggatggttgattgcttgcggtcaggagttcaagaccaacctaggttactccatctctacaaaaattgtaaaaaaaaaaaaaaaaaaaagaaaagaaaagaaaaaaaaaccagccaagcatggtggcgtgcacctgtaattccagctactaaggaggctgaggtaggaggacagcttgagcccagaaggtggaggctgcagtgagccagtatcacactactgcactccagcctgcgtgacagagagaccctctctcaaaaaaaaaaaaaaaaaagattttgattagatagttaccagaggtaagtagaagaaagcagatttaagaagtatccaagaggtaaaactgacaagatcctactgattgatgtgctattatcttaaacccaacaacatataagcttaattctaaacatacttatatataccttaacgactaacaagctctgaaggcatttccaatttaggatatcacaacttcagttctaccttcatttttgcctttataaggcacaaccacccaagctgatttacatatttaaaagtatttgattgaccaactgatggataaataaaactgtgacctatccatacaatgaaatattaagaggcaaagaaaataataaaatattgatatatggcacaacatggatgaaccttgaaaatataaaaagaagccagttacaaagtaccacatatagtataattccatttgtatgaaatgtccagaagaggcaatccatagagaaaaagtagattatggtggctgcctatggctggaggaatggcagtgttgtgggggggccaggaaggtgaaagctaaagggtacgggtttcttttctgaggtaataaaaacggtttaaaattgaatgtagtgatagttagacaatatactaaaaactactgaaactggccgggcgtggtggctcacgcctgtgatcccagcactttgggaggccgaggcgggcggatcacaaggtcagcagatcgagaccatcctggctaacatggtgaaaccccatctctactaaaaatacaaaaaattagccgggcgcggtggcgggtgcctgtagtcccagctactagggaggctgaggtaggagaatggcgcgaacctgggaggcggagcttgcagtgagccgagatcgcgccactgcactccagcctgggtgacagagcaagacttcgtttcaaaaaaaaaaaaaaaaaaaaacaaaaaaaaactactgaaactaataaaaacatcttggctgggctcggtggctcacgcctgtaatcccagcactgtgggaggccgaggctggcagatcatgaggtcaggagctcaagaccatcctggccaacatggggaaaccccgtctctactaaaaatacaaaaattatctgggcgtagtggcgggcgcctgtagtcccagctactcgggagactgaggcaagggaatcgcctgaacccaggaggcggaggctgcagtgagccgagatcacaccactacactccagcctggcgacagggcaagactccgccttaaaaaaaaaaaatcttaagtaggtgaattgtatattatgggaattacatttcaataaagctttttaaaaagtattgggcttttttaacacttattggttatctatgatgtactggacagtaaggcaaacacaggataaacagatgaaaacaacaggacttcagccccagaagagcaaaaaatctgcaaaaaataaaacccctgtaaaccaagtggcttctagtattaagatagaataccttgctatgtgggaaacatccttgacatctttaagaaaaaaaatgtttactttacctaagaaacaagtccagttttcttttaattcttaactctacagaggtatttatttaataacagatctattccaattcactaaccaaaaagagtacttaatcatgcacttaaagaaaattctctataagatataattcctttgtttgaaaaaaaaagagagagagaagctatctccagataaaacgctttatccagggacttcttttttttagagtgggcactctaaaaaaatgggatctaattgtttcatgtttttattaatgcaaaacgacattacccttcagttttgtgtccagccacgtaacattttgttcagctgatacgcttttacttgaacagatacaaaaaagattcattttcaaatttgcaccaaaggtctgaagatcagggctggactgatattggaggcaggtggcagacaatgcatacctacaaaaaaaagcaggggcacagaagaaaggctataactttattattattattatgtatatttttttaagatggagtctcgctctgttgcccaggctggagtgcagtggcgcaatcgtggctcactgcaacctccacctaccaggttcaagcaattctcctgcctcagccacccgagcagctgggactacaggcgcaagccgccaggcacagctagttttttgtattttagtagagacggggtttcgttgtgttgcccatgctggtcgcgaactcctaagctcaggcaatctgcccgccctggcctcccaaagtgctgaaaggaaatatgaaagatttaattaaatgtttcaatataaacacattcgtggcagaatttttaaaacaacaagaagttagaaacaatctacttttccaatacaagtatattggaaaatatataataaatgatgtataaatgaataatagttgatgatagaatattatacagccattaaaattgatattttacaaatacttccaatgatatgaacacaatgtgctttttatgttaactgtaaaatatcagttacaaaatagcatatttgatatcatctcaattttataaaaccaaagatggaaaggagaaaactggtaaggatatttacaaaatgacaagtaagattatctatataatattattatgactttcaatttttaataattttgtataggctgggcgtggtggctcatgcctgtaatctcaacactttgggaggccgaggggggcggatcacgagctcaggatatcgagaccagcctggccaacatgaggaaaccccatctctactaaaaatacaaaaattatctggacgtggtggcgtgcacctgtagtcccagctactcgggaggctgaggcagaagaattgctgggacccaggaggcagaggtttcagtcagccgagattgtgccactgcactccagcctggtgacagagcaagactctgtctcaaaaaaataataataatgataataataataataattttgtataattaaatttttttagaataaatgagtatttctatcggggtaagaaatcaataagtttgtagtcatttttcatctcctcatcaagtaaaatgcagaggaaaatttttctgagccaaaatgagagttctagttatttgagttctagttgcctaaagtttttacatactagtctaatgtgctgacttctctattttctctggacttttaccaatgttgttctttgtaccagaagcatttgtagcaacccttcctagaccccttccactggctgactctgaagaataaagaggcagaggtgtcacttcctccaggaagactttgggcaccactcacatatgtgccgatggaactctgggcttaggggttccacaccatttatcatagtacgtggtactgtggttgcctggtttcatattctcctcccctaccagactctaagatactctgaaggccagaaacgtctaccttttgttcactactatatccactatcattcctagcacatagtatgaacatggaatattcatttttggaaaaagtgaatgtattaatgaatgagtgagtaagtgaatagtctaccttagaagctaggcatgcctaattcttagaagcatttactctgaagtaaagcaggggtgtttcatataatgaaaacatcggagtgtaatcactcagtactttaagcaaaagacaggtcttaatgctgcttgtgttttcagagttcaaaactctgaaagcatgaagctagtagaaagttaaatatatccaataacagggtattaaatatgttaatgtcttaaatacacaatttgcaaataaacagaagtaagttgaaattaagggagacaattaaaatagattataccacatttcctgaacttggttcccaaagatcagattcagatgttgcttttattcataagctttgaaaaagtaaataaaacattctgcacactgctcaccataaatcttaactcaccattcaaatttaatctaaacacaaacataaacctaaaacctcctccagtcccacaaatactcagacaaccaaaatctgatttccaggacaaaaatgttactctacaagtacaatatttatgctgaagagataaattatgcaaatcacaatggtttatgcttatgttatagctacgcttacgcttctgcatacgacaagtttcaagagtctacaaatttacataaagctcaggttgtctaatgattaaacaattttactatttaggacagttttaatattgatttagctttaagatatatttgggaacagcttcaaatgatatgcactgctttacattattgacttagcacttgatcacagtatctctataacaatctcaaaaattaattcacaaattaaacctctacttcatttaaaccactattatattcacctttcttccatgctgtctagaaatattttttcttaagtaatttcaatgaaatcgcaaagctatatttaaactagatcaatcatccctaacctttggctaactgacaacccaattagccaaaactgtattggtaaattttccaaatgtaagttttaaaattcttttatatttttaaaatatcgatacatatatgaaaatgttggaagattttagaataattgaaatttcaagcaaagtaattagtgacacctcaattaacagtggaatagcatccgatttttccagtgaatttgggaaaaaggcaaaatttctgcttaaaacaagaaaaaaaattcctattcaaggaatggaggaaagcatcacatgaataagaaacaaacatgactatcttcttagtcaaaaagactttcctgccacactgctgtagcactggagattctgggagcacagtcccagccctggagttgctcacaatgtagcagggaagacagctgtgcaaacagataattagggttcagagtattcaggggatgttgccctaaggtctttgcagtagtctggtgctacttttttaactatttaccactactactactatactaccactactaaaagtaaataaagtattttcaagaatttctaaatctagtttggagcgctatacaaatgtacaaataattgtcccacaagggacaaagtaataagtgccttaagaaaaagactgcaaaataagaggtattcctgggaaacaatatggataggacacaatatcaaaagagtgtcagaaagagatggaggtagaaaggtaagcaagcctacactcaaggagggatactgagcacagaggtaagggcttactctgaatacagagagtctgcaataaatgaagttttggggctgagcactggcaaagtcagaggtgtttttaaaagcctccaatctcaatcactagagtatcctagagaaagtctaaagttaaagtgggcaggtactgcaacaagcctatagtaggtcagtgggaatgaaaaggagttaaaagagtgatgtgaactcacagtataaaccactcccctgccctccaactgcggagcaataataatgagactttttcttttaaggagaggactgttccagaaggcaatgcaaactaaaacaatctacttccaggacttggtaaatgacaagagtggaagaagaaataagatgacgatcattcaagtttttaagcccgtgagacccagagaatggacacttacagaggctgattaatacagtatgaatacagtattctctgtatgtgcttatgctacaaagcattttataaagacagcttccagtgtaccttttggaaagggaatgtgtttgcactttgtagaaaagaacgggaactttaaacccacctgtgctgaacccaactacccactaggcgaggttaatatgtgtccacatttatgctctcattgcagtgcaagacaagactgcccaagccttaaagtatcccactgggcaggtttgtgcgagggccttcacctcctgtttaatagtgtggatgaacagttgttctccatttcacagatatcaccactgcaaaaactgaggccacggggaaagtaaggggatcaggtgactacttaaggtgatggaaattcttgctatgtatttcttttttttagttaagacagagttttgctctgccacccaggtcggagtgcagtggctcgttattgcctaactgcaacctccacctcccaggttcaagcaattctcctgcctcagcctcctgagttgctgggactacagtcctgtaccactacacccggctttttttttttttttttttagtagaggtgaggtttcaccatgttggccaggctggtctcaaactcctgacctcaggtgatcggcccgcctcggcctcccaaagtgctgggatgagccaccacgcccagcctatgtatttatttacgaaagaatggatgcaggctgggcgcatccattcttgagtaaatcagtgaaccaagcttgcaccattgcactccagcctgggcaacagagccagatgctgtctccaaaaaaaaaaaaaagtatgcaaaaataaaaatacacaaaaacttgacagaaacaaatggcaatgtgaacacattgctggggccttttcccagggccttgaaggaaaatccacctctgggcctgtgcacctatttagaagaactggagcttgctggtcctctgaggaagctgaaaggaaggcaggaagagggtagtctcgggaaccacagacaccttcccttgtgagaagcagcagtaaactttctggacagcacccaaagagttaaaattacccatgaaaatataagtcaaaagagtggagtggcttagaatggctgattactcttctaagaatctcatttgacagaggtaaaatacaaagaaagtgtgcgctagtttttacagaaaacatatgggaacttacctggggaaatttgctttctcttaactaaacaaggagtcttttcaggtattttgagttgaaattgggaaggacagtcttaattatagaaaatgtggagaaagactgagccattggagaatggtgaccatggtgcattaatattcaacttcattcctgggtaggtggaagaagactagaacaggacttagaattttacatacaaagacccagtacagaagaaacggagggaaaaaaaaagtcagtctctacctgaataagcttacacacgagactttaagagaaagatcaacaaatattaaagaaaattactttatcccccaaactgtggctcttcaaaataaagttacaacagatatgaaatgtaaacccttttctgtcccggataccatataatcagggttccatgagaatgcatgcatggggcaagcaaatttcgtcagaactccctctctagctctgaaccccaactgcagaaagggggagaggccctgccccaaatgtggggggcagagtcctgctgggaacccacaggatgactgtgatacaggtggggcagaaagagcaaaaccacaaagagtggcatcctcaagggaaggtcattgatctgcggcacaataactcccaccctgcaacagtctaattcccttcccccatcccaaaactcaccccaaacccacgtggttgggcaggttctcccctctcctacttcttagtgggaagggactggaaagagcaaaagatctgacaatcagtgattaaacaggacaggctagagacgagtaacagtgattccaggctcccttgaaaataataaatggcagaggggacaggaagagagccaattagtacattcccaggcaagagagagctgaggccaaagtaaagaatggaattaaacaccaattttgccagtctgcctacttcagcaacatctctcttcactgatgtgaaactgacaagcaaccaagacaaaggtacaaaacttccaagagtgtcagaagccctgggcagggggaaactagttctccctccatccaccatcacctgtgatcttgagtcagtcatctcagagccctctctagactttactcctattagctgtaaaatgaagaacggggaaacaaaataattttcctaagtcggcctggtgctagcattctagaattctgaaaacagcatgatgtgcatgaaagagtatggactctggagccacgctgcctgagtttaaatcccagctctgccagaattagctgtctgtcactgggcaagttacttgacctctttgtgcctcaatttcctcacttgtaagagacaagaatgacatgctttacatcatggagctatcctgatgatgaaatgatctgttagctgaagttacggtagtgggcttattctatatccggtaccttttgagtgtatttttgtggtgaatcacctaaagagggtaactactctggccaccgcttcctacagtgcttcccctcctaggcaaaaggtagataatattttctttcttctttgtagagacgagggtctcactttgttgcccgggctggtcttgaacttcttgcttcaggtgatcctcctggttcagcgtcccaaagtgctaggattagaagcatgagccaacgcgccctgcccttagacaatattaatcaagcacagaattatttccttagccaggatgcagcttcagaaccgttactgaattagaatcactgaatcatagcacacaagatgagtcagccacatcctaaatatgggtaatattgtgtcccttcatcactaattccatcacatttggttcaaactggttcaaatgtagtaccctcaaacatacagttccagaaaactccttctggtggaaaggatgtccaggatctttacagaagagaatctccagcctggatttgtgacaactgaactctctgacttccagttccacggaccaagcaaaccatagctatctccgcagatatttttacgttaccagtgaaaaacaatgggtaaccacagatgaactgacttggctgatgacactccataaagaggtcattcctgggccaggcgcggtggctcacgcctgtaatcccagcactctgggaggccaaggtgggcagatcatgaagtcaggagatcgagaccatcctggctaacatggtgaaaccccgtctctaccaaaaatacaaaaaattagccgggcgtggtggtaggctcctgtaattccagctactcgggaggctaaggcaggagaatggcgtgaacccaggaggcggagcttgcagtgagccgagatgacgccactgcactccaccctgggcgacagagcaacactccttctcaaaaaaaaaaaaaaaaaagaggtcattccttttaaacatgacaagttgattcaatgacagtctacagtccaaggcaaggccttgggagcaaattcttggtggtgatatggtaggataaagagaaaagggagccctttaattaacaagatcagtgcctagcaaatttgatcctggcaaagatcagaggataaggaaggagagaaatcaactccttcatatgcctcacaccctgccaaggttgacttgcaggacaatcccacactcctcagcctcaacatgtccaatatgcagggcctcctctttcccacctgtttttccttctagattccccaccttagttgaaacgaattccacctcctacctcaaaccaagctcctccttggcatctctattccctctactccattagcacctggttaaattgtaatacaatcaaagtctctagtcttgctcctctcaaatccatcctccaaccaaatctcacagataattctgcttaaaacccaaaggttcttacatgcaacaacatggatcaatctcagaagtattatgctaaaggaaagagacagaattaaagcactacatactgcatgagtccatttacatgatattttgagaaacacaaaactataggggcagaaaacatcagtggttgctagggactgggggtgggaggagttagtcactcaggagcactgggggattttagggagtaatataaatgttcttcgtcttgattgtcacggtggccatggcacttatatcaaacacaccaaacaatacaataaaatgggtccattttactgtgtataaattataccttaatttaaaagaaactaggggaaaaccctatagaccctccccattgcctacaagttccatggcgttcctgatctggcccatatcttaccctacacacttcaacaacactcaactttttaaaatgtcctgtgctttccatgcagaagcatctcaccactgtacccttcttcaacgcagcttttccagattaattcctaagtcctccaggcatgtctccctgcttctcccacctctcatacactcaggctatgtgtttgataggtgtcctcttggctcttacaatgcctggtgtttcattattatttcattcacagaaatgtattatacatgttataggcatatgttatagtataatggtcttgtctctcaccagtcaactaagatccaaattctctgagaaacgaactactattcattcacatgtgtacatgctgcctggcacactgcagacactcaataagcctttattggaataaatgtttcttaaaggcaggtttggcctgtccactttgttggtataccctcatcacttacaagagtgcctacttggctcaataaatacaggtagtcctcattttgcatgataatgcaataccacaaaagtgatcatgcgcgctgaaatcatgtgaaatgatttttttttgagatggagtctcgctctgtcgcctaggctggagtgcagtggcgcgatctcggctcactgcaagctccgcctcccaggtttatgcaattctacctcagcctcccaagtagctgggactacaggtgcccgccaccatgcctggctaatttttttttatttttagtagagacagggtttcaccatgttagccaggatggtctggatctactgacctcgtgatccgcccgcctcggcctcccaaagtgctgggattataggcgtgagccacagtgcctggccatgaaatgattttaataatcaacagaaatattatgattgttctatgacctttaatttttttgtcaaaacagtaaaaactgtctatcagctataaatgtgtaggaaaatgaaaagtatatttatttagtactctaaaacatcagaaactctgagaattgttttatttatttataaaaaactgtgtcaatagtagtttcaatgggaatgccttattctcgttgctaatttacaattctaaacaagcatcttttccatgccttggtagataggtatacttccttctaagttcagacttgcttccaacattttatcctttgtgttttcacagttatacaatatctgtgagagttcctctcatatgattttttttgccagcatctttcctctgttacatcttcatccttttcatcacaaccacttcataactgactttgataagttagttatctttcactaagtgctcctagctaaatatatagagcctctagaacactggctgagttgacattcccttggtaagctttttttttttttttttttaagaatgctgtttacaattagctaaaattttaatccaattttaacacttcatttatttgatgcactttgatctttgacaattctcccctttaattatccatttttatgaaatgctacatgggtctatcactgggagacaagaaggcaacacgactacatgctttgctgtccgctgatgaacaaaataacaggaagtgctagtgtatgggattttatacaattatagatttttttttttcttttgagatggagtctcacactgtcgcccaggctagagtgcagtggcatgatctcggctcactgtaagctccgcctcccgggttcacaccattctcctgcctcagcctcccgagtagctgggactacaggcacccgccaccatgcctggctaattttttgtatttttagtagagacggggtttcaccatgttagccaggatggtctcgatctcctgacatcgtgatccgcctgcctcggcctcccaaagtgctaggattacaggcatgagccaccgcgcccggccacaattatagttaatgtaacatgataactgaaacttggactgtgttgagggactagtattatttagttaaccatggcaactgaaaattgtgtatattaaaatcatgcaaagtgagaaatatctgcatttagcaaatacaaattattttagaatgaactggctcaccactgggccaaatttaagaaacagagattgatgcccttcccattacaccttctgactgataacatcacagaatcacagcaacttcctaaagaccccattcacagtcaactataacagatgagaggagaaatctagattataattcgaacactgttactagtaacaaagtcacatactgacactgtgtttctatgacttgccctataaaataagtaatactactacctcttcacagggtggcgtgaggaccaaaagagaaaatagattaaaaagtacttttaaaaattcaactagaggccaggcacggcggctcacacctgtaaccccatcactttgggaagccaaggcaggtggatcacttaagcccagaagttagagaccagcctgggcagcatggcaaaactccatctctatcaaaatacaaaaattagccaggtgtggttgctcgtgcctgtggtcccaactacttgggaggtgaaggtggagggatccctttagcccaggagacggaagttgcaaggagccaagatcatgccactgtactccagcctgggtgatagaacaagaccttgaccctccaaaaaaaaaaaaaaaatcaactagataccatcataccaactatacactcagtatgcaccaggaactattttaagaacattttacaaattttcacttacaatcctcatgacaacctacgtgatcagttgcattataacccccattcagaataccaaagcataaagaagtcaaataacttgtccaaaagcatgcaacctgtaagcagtgaagtcaggatttgaactcaggaagtgtaactccgtaagtgaagttcttcaaaacttcatcactaacttatctgctttcctcagaaagaaggatacagtcattgagaagggtataatattgactcctagaagccaggcaaacctgattcatataattcaaagatcattgccagttagttctgctgggaaattttcaggtttctggcaaaagaacaaggatgcacaatatgcagagatctgagaagctagaaagaccattcccagtctgcagaaggggccaaaagaatagttcaaatacattcaattccttcaattctagtgagtagaagcataaataccagcggggggaaccaactaagaaataaagtttactttgcaagaagagggaaagaattcgtatttatcataagcgtataaaaaagctagagtgctataaaaacaaggtatgtaaaaccaacaaacttcattgacattttcagtaacactgaccctgaaagttaataacattgtttgctgaggtctgatttcacaaggaattccatatggaataggaacgtgggagcctaataaggatgtatgatacaaaagcaaagggattagttaactaaaataagtggattcctctctaaatataatctactcataaggatacatttagaacatttgtatctcattaggggtattaagtgagaaaagattctcaataccaaatagtcctaattataattcatcttaggaaataaagtgagttttcttaactaaaagggaaaacatactgcaagaaacagctttaatataacaacaggattgtcaacaaagtcagacaccaaaacaaatccaattgcccaaaggaatactgtgaaaactgaataactgctccaacaatacaatgtttttttagactatttctcaacactttacattcttttttctcttattatcaatcataacaatccaaagccgaaatcagttacctaagcaaagaaaatccaactataaacagcagaaacaaattaaattaatataaaccatacaaaccaaacacgaatgtatttaccccatcacacctttcatcaaggttctgccagtggtgaaaatgacatggttaggatatgacttaacaagccagtgaacattttctttgggaaggatcaattctagttttcttttgtcctttttattttttttgacagggtctcactacatcattacccaggctggcctcaagggattctcctgctgcagcctcccaagtggctgggattacaggtgggtgccactatgcctggccaattctagatttcgatcccacccaaaggggtacttgccttccacatctttttttttttttttttttttttttttttttttttgagagggagtctcactctgtcccccaggcttgagtgcagtggcgtgatctgggctcattgcaagctccgcctcccgggttcacgccattctcctgcctcagcctcccgagtagctgggactgggactgcaggtgcccgccaccatgcccagctagtttttgttttttgtggtttttgtttttttgtttttttttttttttagtagagacggagtttcaccgtgttagccaggatggtctcgatctcctgacctcgtgatcctcccatctcggcctcccaaagtgctgggattacaggcgtgagccaccgcgccgggccttgcctttcacatcttgaaacagaaaattatttaaatgatatacattggattgtgtgacttagttataggttataaaacaagtgagaggtagcacccagtgctgggtatcagtgacatggctctgcctttctcactgcaaggtattgtcctcaggctggccaagaaggtccatctcctctgtaagcatctcagccacatttcaagcagtgatgtgttttttattccagatgggaaactctcactaccgtcccccagcagacttcctcttacaaagtattggtcagaacttaatcacatgactgctcgtaaaccaatcactgccgaggggaatgcaattatcatgactgagcttttttcacattaatcttgagatatctcctgtctgttcattaagaccaaggctctcctgtttccaaccgccacccccagccacctgggaagagagaggtgggatagacatcattaacagggttggcattaaaattcacctcaattattctaaaagatccgtatgacaactgtaaaagggctgttttttgtaaagatgcactatagtcattatcatcatctaggcctgggtccctgtaacttaagaaaaacactccaccattagacaaacaaaggcaccagaatgcaatgaactataatactttacccattaggtgagtaagagccagtaaatcaaagggcttttaaaaaacacaattcctcagctaacaccatgaagcaaaattaaccatattagttctcttcaattttacacttttgggggtttagacctctcaatcactccagatttgtttttcaaaaaattagctgtcctttttcatttacacaattttccccttcctcaagaagaagtgtcaggctcaaattacaacagcttatctgatgggggaaaaaaaaaacccatgcaagatatattcctatatttgggcctttagtgataagttcatgataaaggaaaatacaaatactctctcctcctccatgcccacgaacagcccaagacttggaatcattcttcacagggttcactcactatccagtccaactctcaacctccctaggcctttagcagatccaagaaagatgcaatcctctcaagtttccagaacaatgagaataaaaagaaggctgactagagttgaaaacaggaacactgcctgcatcttttctcactttttttttcagggagtcctttaaagcagtgtaggcggaaaagaataagcaaaggaagtaggaaggttcaacacaagatagtaaggcgaactccacatgtgaccggtctttctacagtccagagacgcccaatctgcacgcctctacacacaacagaactgacacaaacaaatgatgactgctaactgctaattctggcttttttttttttttttaaacacactccagaagtcattgcaataccggaaacattgggagactgagccatctgatgacaattacaggaatcctggaagggaaagaatgctcaaggaaggccagacggccatgcaattataaaccctagctcagcccatgtcctctccacaccctccacatcactgccagcgagaggaggatggtgacaccattaaccaacattcccaggctgatcccaggctcacacacactgctccagagaggatatcatgattttggtttgcttggttttcttatcctttgaagtaagacacttcatgattgtcatgagtttggttcccaagggtgtgagatttataggaaccaagacttttacagtaaagagatgatttaaaaggcaaaccactaaaaatgacagtatgaaactaaaacgtttccaagttgctttaatccctgaactaatccttgcagaatgccagggaaagaggatgggaggtaaaggtcatggttaggaagagaaaaagagctaacatttactaagcacctccaagagcaagccactttcaggataaagaaaccttgcaaaggagagagcatccaagtctaaccagaactaaggctcagagagacaatttacgcagtctcaaagctcttaaatgaagacaatggagtgaagccccaaacccatctcacttcaaagcccacactccttctactaagcaacactgttagtgagacagcaggtacataaaacagagacaaagccagtatgacacaaaatggcattaaccattcactatctaaccaaggcacaattaacttggcttctttcgtaagtactttatatagttttacatccatttcttttcaattaatatagcataagtataatcccatataattaaaaatttcacaaaagtctagtcctttaaataactacaccctgatagatttcataactgatgtcttctaacttaaagccctgtgctgacaggactaggaaatttaaaacatttgaaatagtacatatttaatgaagaagtctcaggaagcaaggaagtataggagactgcttaataagaaatcatgaaaggcaggagaatggtgtgaacccaggaggcggagcttgcagtaagccgagatcacgtcaatgcactccagcctgggtgacagagtgagactccgtctcaaaaaaaaaagaaagaaaaggaaaggaagggaagggaagggaaagggaaagggaagggaaagggaaaggaaaggaaagagaaaaaaaaagaaagaaaagaagagaaaagaaagaaagaaagaaatccttattccatagaattcctgctgtttcaagagaatgtacttgagtagaatcgtatttgacaaatctttataaatgggaaacattatctataaacacacacacaagtgtacaaaaattcaaattaggattgctaactaccatttatttatcttcaactaatgccttttgtgggtctctgtacaaggtcaaatactgtcaaattttccttaaattgtcgcaagttgaacacttgcttcagtctgttagcaaaagtggggcttctacgatatggcacaaaacaagaggtagcttttgttaaggtagctacctgactacctcacaaaatatggtgttggtagtaataaagtgcaacaggaatgataaaagtaaaaatgatgatgatgacaataatggcagctttcatttactatatctttctcagtgtctgtcactattcctaaagcttaatatagatttttttttacttaaccttctctaaatcccataaggtagctactactattatccccaaaaagtaacaagcaagttgaactcagaaaacttgagttcaagtccacacttggctctaataagctggaaatagcttcatctttctagatacccaacttctccactatacaatggaaaggatgaggttgggggcactgtagattaaatgagctcctctgtactatagatttgacatccctctgaaaatacatatatgcccctcccaatccatggcaaacacacatcactaaacaatcatgccagtgaatctcattatgacttcaccatctttcacagcacaacacactaggaagttactaacaatcaacatgagctagcttttaaaatgaaacctcgttggcctcttaaggatgacacaatatcacctagctggaggctaggtatgcatctagtaagagtgtcacacaagtccaaaagctaaagtttggcaacttaaaatttgaacaccaagatgagattgagtctgtcaatatctggtatccagctgaaaagtcttaaaagaaactggggtttcttgccaccctagaaaccagcagacctaagtagtcacatatccccaccaaaagttgcccagggcaacaaatgatacaactccagtctaccagtgtggcatgaaaatttatgccatgtcctaggaaaggaagcaggcctatcccaccaagagaagactgccttcagaaggaaagtatgggatatccacaggaaaggaagagatccaaattctgattttcatctggctctgatcccatgtattaagttaatgttttagctcagtgaaagtaattaccagctaggctctgcaatccatcagttcaccctgggcattcctgctgattctttctttggtctctaggacccaagaatcccttttgttgatctggaagtgtgaaggaaaagttggttgttactagcttctgtctttctattctaaatttctgccaagtaattaggaagagaaaatgaactattttcaagttttttaatggaagctatgcagattcgaataggcacagcctctcacaaaaataagattaaaaccatatatctttgatgtcccaccttccaagtagaatggacaaatgcaatttggctctaggctgtgaactcagggactttatccaaatcaccaccattctaatttaggtaatttggcaagattagcttagtcaataaattaaatatatatggatttacaaaagattttcacatatccccacaactaccctaaaggaaaatattatttgtatccccattttgcagacaagtatgacaaagttcagaggttaaaagtactaaccctaagatcaaagtgacaaagcagtctcttgactccaaacactagacttctaagtaattttttcaagtatggtagtatcttatgatttaaaggagttcctccaaccagaattaacattcaaaactacattaaggactttaccaagtgccattcagacagcaggcaggtaaatttttcattctccactaaactacgtagaaattatagaggaaatactgaaattattcccctatgctccccaccaccctgtaagtccatttccattgcacaactacactgaatgggcaatataaatataataaacatatgcccacagagagcagaaggtaaacaatcacgcacaagtaatggcaacaatggtgagccctttctgccacttaagctgtaaacacaattgctgactttggtcaccagcaaaccccatgggaaggtggcccacagctaaatacaccactttctatctatccaaatgtcagggggctctgagagtcatacaaacatcaacaagcctgtagtttttatggctcagaaccaaggttctgggatctgcaatttgaatggccagtgcttgtctccttaggcatgtcaaaatcagttataatgcacattattttcctttttttttccgattctacaagtaatacactctagctgtagaaaatataaaaaatgtaacaaagtataaagaagcagaaattagtcataactccagaggcaacaactgataatattgacctatttccttccagtcattttttttcctgaaaaacattgtttccttttctgcagaaagtatttactttctattttatttatttatttatttttgatatggagtctcactctctcacccaaactggagtgcagtggcaggacctcagctcactgcaacctccacctcccagattcaagccattctcctgcctcagcctcccaagtagctgggattaccagcacctgccacaacacctggctaatttttgtatttttagtagagacagggtttcactatgttggccaggctggtctcgaactcctgacctcaagtaatctgcccaccttggcatcagaaagcatttactttcttcaggcaataacaagaagggcaaaatagcccaaaaaaaaattaatcccattgtatttacagaactaactcaaatttccccagtaaaatcttgatgctaactacataaaaaatgcatgaaaatcctctggaaaagcccagtaaggtaatcacccaagtccttctactggaacacccacaaaaccagaagaaacaataatctatagtgaatataagcggtaaccttgtcagattttgttttttcagaacttttttaccttccaaaatcctatttttgcactgaaactattaaccctaattatcttatcagtgacaaaaggaactttggctcacacagagaagaaactatgtagaggccgggcgcggtggctcatgcctgtaatcccagcactttgacaggcacaggtgggcagatcacctgagatcaggagttcgagaccagcctggacaacatggggaaaccccatctctactaaaaatacaaaaattagccaggcatggtagcaggcgcctgtagtcccagctactcgggaggctaaggcaggagaatcacttgagcttgggaggcagacattgcagtgagccgagattgcaccactgcacgccagcctgggtgacaaagcaagactccatctcaaaaaaaaaaaagaaaagaaactatgtagaaaggggtggcatgggatggcaggtggatggaaaaacagtcttatttccttctcaaaattacacttctagaagaaacgaaatactatctaagtaccatatacatgtctttttgcatagtatataaccaaggagcacagcgtctgtcctctctaatttgaaatggatagctcaaaagtaaggcaaatcctgtctaataaagttgaggggatattcttttcatatcaaaaaaaatagagacttaaatgcaaccagttacttaaccagtaaaagcactacttttgtaatgcgaagaggcactggaactcttttttttttctggcaatttcattgatcatgtatttctaaggtacctatttaagaggaattcatagaaaaagtactcttgtactacttatcgctaagtaaagataatttttaaataattttcagtgcaagagatctggaattttactccctacagcctagtgattttaaatgccctgtgaccctctgaggcactgccaacatcaacatctggtacctggtacaaagaaaatgtattttcaacagtttttaaaaacctcttctttttcatcatgtgctttaaatatgtttctaagatagttgtctttctctcctttctgatgtagaaaaaaaagggaagctattctatcaggcaactacgtgttttagaagcaaaagggaaaaataataaccaaaaattaagttgttgctaatgttttttcattcctcccaaaagaaagattacacaaaatagacatcttcaacctgactagatgaaaaaagaacccaaaatgattgtaattattgccccacaagtatatacacttctaaacaagacttcaaaatccaaagtatatcccctacacaattctccgtatttctgatttcttcctcctttttcacatgtaagtctttttgtgaccttcaaatctcccaaagactttagcaaaaataataatgatagtactattgataatacattcatcacctttatttttatttattttgagacagagtctcactctgtcacccaggctggagtacagtggcgtgatattgctcactgcaacctctgccccctgggttcaagtgattctcctgtttcagcctgccgagtagctgggacgtgcccggttaatttttctatttttttttttcttagtagagatggggtttcaccatcttggccaggctggtcttgaactcgtgacctcgtgatctacccacctcagcctcccaaagtgctgggattacaggcgtgagccaccgtggccagccccattcctcacctttaaatgctgtactttagcaaacaagctcattcaactaaacctcaagtacttaacctagaagtttcaagttacttttaaaaagcaatacagctataagcaaaactgaccatactttacaaaggagtgagaaagccatgccaaaagaagctgaaatattttattctaagacacccccttaaattaaaaaaaaaaaaacacacacacacagaaaaaataaaactgcctctcaactgtaagttaattaattgaaacaaagggataatcccttactgtatagcttcaaaacagctgtgtgaaggttcatttctatgtaaacttctccttctctgtggttctggctcaagtctgaagttatcattatataagtaaaacagcccataaaagtttttcccgtttcagtatcatcaactagtatacaggagacatgcaatggggcagtccacagctaatgcatcaatttttttcacaagcactcatgttatgccacacgcctgcttcgtatccaaaataaaacgactgtcttccacattagaaacattttctcaaagaaaaaaacatagctatcattcatttcttagccaaacatgctcaaggatacgcggcattggggccagttaagagtgcaaatatattagctgcgacttcagcaagtgcctgtcatgttgaatagcatgaagaagagagatagtaattattgccgagaaaccattagagggctccttagtaaaacaagatgcccgagcaaactaatggaccaacagtccactgcagtgtcttttcctattccatttagctgcatgtcagtcctatcaaatcatctgacacttgcaatgcagccaggctcagtacaattagcaatatccttcactcccgtgcccattcactggtgctacaataagctgctacatttgtacagcaagaaatgatttcttgattgtttgtgacacagagatctaaagcccttcctgcaaggcaaatgtgcattggtcttgcttcagcaacagaagcttcaggtcttatgtttatacaagagagacaactcctagagtagagacaacttgcttcacattactcatctctcccattctttgtccatctctagcaagacacttttcaagcccatagacaaggaccgaagggtttttgtaagaacacactatttgaaattccaagactgagatcatggtgggttctatgtgctccacatgtgaagcattttcagacctagagattctgctgggaccagagaatgttctctggatttggaaataggcaaagcaagtatgatgttttcccttcattttcttgaccaaatggagggtcactaactttggggaataaagacacgcaactttgtactacttggcaaacttattcataagctattgcatttttaaaaccaggtagcaaatatttggttggtaaaatagagtagaccatcacacagacattgacttaatattctccccaagtgtctctcacttcataatctatctacaagtgaacctctaaatggccatctgttttagtgattgtagttttcctatattcctaaacatttggacttgcagaaggacccagaatgaacaccagctctagatgtatcctgtgtgtttccaacaaagcaggaaggcaccactccttggctcaattgtgaaatgctgccatttcaaaaatcatcagtgccaaaacatttattcaaaagtgacagtggagacaattctgaggacagtgctgaaatcctgctggaaatgttttagccctcaactttagtcatgctatatttcacctaacagctaatttataatacgtacctctgccccaaaaagagcaaagttaatgagttttattacaacgaagggaggcaagggctggattatccagcacatagcaagccttcaaggagggaagtgacgagttaacatgagacattgtgaatatttggaagacaaccttcctttaaatgagacactgctggtaacggtaatggggaatttgcaatgaagggaaggacatgcaattataatctggctgggccccactggacaaaaagtgatttacttgaaagctgcctttgcactcagtaaatgttcctgttatgggctactcagccggtgacagctttccagatgtcaatcaaattatcatctatttacagttgatttggtagtgtcatttgcaatattccctacgtttctgatgaaattggaagcacagaattttctccagtttgccctggcactcgagtgggcaaactgctctttgcaaatgtcatgtgtccgcttatcagcactctaaggagtgcgatcttgcattcggctgagtgaatcgctaccagatgcaaatctctcaatcgtcaagggaagactatggcaaattttaatgtactttgaaaaactcagtttacatcagtgctcaaggtgcagctttacccaggctaacagtttttgtataacaatgagcctaaattaaagcctgaaaaacaaggaaatacttttaactctttcaggcttctgcctgctccacgctaaagaaaatgatgtacagaactatacttacaaaatgaaatgtcacagtagtttgccgctagctataaaatttaactctttgaggaaagatttgcatatgagttattattcttgtcaataaagcatcataaaataattttattctaaaagtaatgcacaatgattaaacactcattatcggctaactgttctaaatatttcacatgcaaatacacaatccccagaacgttttgatgtaagtactatcattgtctccaaattacagatgagggcattgaaacacatggaagttaactgacttcctcgtggtcacagctagaaagctgcagtatcaagtccaaatctagactccactgtcttagtatgctatactctatgcatgcatatacatgcagatgctcacaagcacatatgctggacatgagatatatgcctcagcacatgaccgctcatgaaaacagaggttatttccctttcaatttttcaaaataaaactgcatgtcctggagataggttgtttttagaggatctctccaattccttaaaaaccaactggaacacgaagtggagtatgatacgcacagaatgaacagccactcaaatattagtatttgcaagcaaatggtgcatttatttcacatgtcagaaaatgtattttcactgcttgggggagatcctggtgtggtttaaaagtggtgtggagaggccgggtgcagtggctcacgcctgtaatcccagcactttgggaggccgaggcaggcggatcacaaggtcaggagtttgagaccagcctggccaatacagtgaaaccccgtctctactaaaaatacaaaaattagccgggtgtggtggcatgcgcctgtagtcccagctactcgggaggctgaggtgggagaatctcttgaactcgggaggtggaggttgcagtgagccgagaccacgccattgcactccagcctgggtgacagactgagattccgtctcaaaagaaaaaaaagtggtgtggggatctgtttggtaggtaacaccactggatcaatataaaactatctcgaatcttcaaatgagcattataaataatccatggacatagtagggtttgtcagagaacacatgccatctttagaatctggaagactttatgcaaaggtctgcaaggctacataagcacagtcaaatttctatgtgaatgtagccaaacacatgaattccctggctattgtttcattcaaaggaaattcattatttttttgttggtttttttttgagacagggtttagctcttgttccccaggctggagtacaatggcacgatctcagctcaccgcaacctccgcctcctcggttcaagtgattctcctgtcttagcctcccgagtagctgggattacaggcgcgtgccaccacagcctggctaatttttgtatttttagtacagacggggtttcatcatattggtcaggctggtctcgaactcctgacctcaggtgatccgcctgcctcagcctcccacagtgctgggattacaggcgtgagccactgtgcctggcaggaaattcattttaaactacatggaaactgcatgagaaactgcaatgaacaaattaaagtacttacatgtataatttgcatacatgcacacacacacacacacacacacgcaaacacagtgtcccttctgaattctgctttagtagggaggggcaaaaaaacctaatggcttaaaaataaaattcacttaaatgtaaaacacagatgggaatgtgaaaagtttgatgctcaggcattaaatactgatacattaagatatattttacctatattggtaactgattacaaatttttagtgtaacagtatattttgattctaatgtgaaatagtttgtgaagcaaacagtacaaatgatttgcttccccaatgaagcagagagaagcaatgcccttaaagaaggaaaggtgtgaccaaactgagggaaagtctcaaaccagtcccaaaatgatttaaaaggggagaatactgaagattaaacagatattaaatcagttttttgtaaatgaccttggctaaagctttaacagggggtgatataaaaatactcaaatatttaaagaaaataggccaggcacagtagctcatgcctataatcccagcgttctgggaggcaaaagcaggaggatcacttgagcccaagggttcaagaccagcctgggcaacatggtgggatcactgcagtgagcagtgatagtgccactgcacccctgcctgggtgacagagtgaggcttagtttctttctaaaaaagaaaaaagaaaagaaaagaaagaaggaaggaaataatgcagaggaacggagtgctattttgaaggttcacttggaacataatgataagaaggaatttaagcaaagtttagcttgattaaaacttgttgtcaatacccaataatcctgggaaattacgccataagtaaagtgttgctttttattttctaattacccaggcaaagttgtatatgtttgtctgaaggggtgttggagaaatcagagaaagacccagaaaaataaggacagtttataacatctctgcttaagtaacagccttaatgtaacttcttcatattagttcttcctatcttacagttctcaacaagaaactacagtctccctatgggttcaaaacatgttttaagattctaaattgtcccctaatcagactgaaaacctggtttggcataggtggaggaagttaacaggtgtcagaaactatccttgaattaaactgagaatagaaactctctccccagattgccagctctgcatgctgaccagaaagagaccatccagaatctgtctttgtcagtgcagcactcactaggctttatagtagaggtgtgctataaatttaactttgataagaaatagtctactttcttctctttttttcaggttagacccaatgtaatgttaagcagattatactttcttgactaatatcatgattattatctatgactaacaatttccattaggcaaagttatatttctctttcctatgcaagtgtttttaagttttagtatccttcttgtttgaaaccacctgacaacttaccattctgggacaataaaaagtcagtgtcaacaccacagatctctttatgactagaatgaataagaataatggcaaatgcattaaatgttatctacagaaagttatttttaagtatcagaacacaacatagtatcaatttccatgaaaacaaggtttataggacagaaactatcattttattaacccaaatcttcttctaaatcttcccatgatcacaaaaagaaataagataccatattattacatcagtctacaaaatatatcctgttttgcaatatgcaccaattgtctcttcatgcaattaaaaaagatggaagttttactggggagaaggttacagcaaaatgaagaaagaaaatgagaaggaggtggagggaggggaggtcaacagggaaatgctccatgaagagagggacctaaaacgttctaaacactatctgtgggaaggaagtaaaagagtgacagaagacacttaattcctgcttacattactaaattgtttaattgaacccattgaggataaagacctgtaactaattcattgattaacataaagctattgttatctaaaatataaaaaattccagttagaaagtgatttctgacacctgaaaattatctttctgtctagaatgccttttttctcactctggagtgagaaatgaacttaaaaatttcctaacagataaactcataatatccaaaaatagaattttataaatatactttgtagaataaaagaacataggcaaatcctagcatggctacctatgtggcagtcagacaagataattaactttctgagcttaagtttccttgtctgtaaaataagaataataatacatggcacagaacctggcaaaaaggaggtgggccatatatgttaattatatgagtattaaaaatgtgtaactcacctatttaaagaataacaaaatttcagagtatgtttctgatagctacaagtgttagacgtatttcaatattcaaccttaaaattttttaaacacaggaagaataaatgaacaataagaaatacacactaatagaatactgacagcaaattatcttttgttaggctaattacccaccattttcattattattctctcggtttatttcattaaaatttatttgacaaacagcagagcctagaatcctgtgctattcccattagaaggatccctcaaattaaaagttagaggtagaggctaacagctgtcaggccctggaatcacaccaacctgagccccaggcctgaatctatcaatatcctagttgtgtgatcttgggcaactttttttttttttttttttttttttttgagacagagtctcattctgtcaccatggctgtactgcagtggtgtgaccacggctcactggagcctcaacttcccaggctcaagtgatcctcccacctcggcctcctgagtaactgggactacaggcgtatgtgaccacaactgaccaatgtttttttgtagagatggggttttgctatgttgcccaagcttttttttttatttcaacttcaattttcctatttataaaatagaaaaaaataagagtagctacaataaagatctaaaacctgggtagcaaaataaacactgtaaggtctgtgaattgctttgaggcccagagactctgaaagcaactagcccaaggcaagcaagctggtgactgggacaggaaaagaacataaatctcctacttcccagaccaaaaaacagaggtactaatgtacttggctgtcccctaaagaagagagctccacctcctctttcaccagccatactgagaagagaggctcatctctgccatctgacaacagctcattcacagacttggaaccaggcacaacactggttcccaggcaacttcttagataccagaattgtttcatatcaaattctaaagtagatcagttgtttcggctgaggcttaaatggcctgggtctaagtgccctttgtcagaacaagggccttgtctcagcgctgcatgtgatgggagctgccgctagaggaagaactgttgacaatgagataagagccaaaaacaagccccctcctggatcactctctgatgaccttttcagtggtctacagtgtgttatcactcaacacattagggctaggagagatttgaaaacatcagaaagctcaatttttttttatggaaaaaaaaatgccttcgattgcagaaatccaataacttcagtgttaggataagagccctgggatgaggagcaagaactctctcggtccagtttttgcttctgtcacagacttatgcaaataaatatgtgatacttttatttccacaccagctttcaataggtcaaacgagggtgtacctgctgaattcccttcctaaaaactcaatgcacagcaattcaggagtctcctgaaccaagaccgaatgcgttgtaatgtactgagtattagctgggtgtggtggcgcgtgcctgtagtcccagctactcgggaggctgaggcagcaggattgcttgaactctgcaagcagaggatgcagtgagctgagagcacaccactgcactccagcctggcgacagtgcaagactctgtctcaaaaacacaaaaaaagaaaacagtgtgcccagaacaagaagccacatcttctgactcaaaattctgagttctttctatatgataaaggaataaaatttgaatggctgaataagaatgtattatttaaattgtataaaaagatgcttcatctttcctaatcaatgctttgatggccatggtccattgatggtcctgatgagtaagaggcttctctgcctcccctctaggatgataaaatgcaaaggtatgattaaagaagctctttagtctttttctgccccctgcctactgacccatctcaattaatgacagtacttaaaaatctgtaatgcaaatgtaaagccactaaggtaacttatggttaaaaacttgctttgctttataaaaagaatatcattataatatgaattgtccctgacctgtctactagggcccactgttatgcaatccataggacaggcttagtgtagtcttccacaagacagcatattttctccccgttcatttaccttggcaggggtggggctagaagctgaggtgagacacaagacaggcattcactctgcctttgtcttcagccttgcaaaaccaaggagtcgtgaaaagaccagtcctcacctggatacccacagcctaaataggggctacaggctaggcgtcccacagagctgtttgtttacctcatgtgaatgacaatgacaatgagtctgtgaaaccagatgctgccgctgcaggccaggagttaagcagtgatgcacattcatggggaaggccctggcaagcagaccctgcagccaaatcccaagcactgcttctcaaactgcaggtcacaggcattggtggatggtgaaaatcattttagtggctcttaaccatttgtgcttaaatgaaactgaacaaaatgcatcacacatagtaaggataagttcatgcacatgtctatgtcaaaaatgcttaaagccagtgatccaaagagaaaagccgctagccagataccctacctcagagttccatgggaatgtagacaaggtgttgctagaccctccagttgctagatcatccttctctttttcaagagaaaccagaactctgagctgtcatatgaaatctccccaaattttttttaaaaggggctcgaactcttttaaaacagtgtacaggggccagcgcagtggctcacgcctgtaatcccagcaatttgggaggctgaggcgggcagatctcaaggtcaggagatcaagaccatcctggctaacacagtgaaaccccgtctctactaaaaatacaaaaaattagccaggcatggtggcgggcgcctgtagtcccagctactctgggactgaggctgaggcaggagaatggcatgaacccgggaggcggagcttgcagtgagccaagatcgtgccactgcactccagcctgggcaacagagcgagacttcgtctcaaaagaccaaaaaaaaaaaaaaccaaaaaaaccacagtgtatagggggccaggcacggtggctcacgcctgtaatcccagaactttgggaggccaacgcgggtggatcatgtgaggtcaggagttcaagacaagcctggccaacatggtgaaaccccatctctactaaaaataccaaaaattggccaggcatagtggcgggcacctgtaatgccagctactcaggaggctgaggcaggagaatcacttgaaccagggagacggaggttgcggtgagccgagatcgagccattgcactccagcctgggcaacaagagtgaaactccatctcaaaaaaaaaaaaaaaaaaaaaaacagtgtacagggaaaatcaaacccatgtgaaggctagacatggactgactattcagtacatatgtaaacagaaatgaggcagcagaactgctcttaagaaaggagtgcaaacctttctgcaaaatgtccctgggaagctatgcatgtggaggcactccaaaaacgcatttgccaagacaacactagtgttgaaaggaaaagaagagcccctagtgaatggccttagtgaagggggcaaagcagtaaaacattggtgggcctgatggtttctacaaagctgtcttgagttgggttagatgatgcagcggaggtctcaaacagaaatctaccttgaccttcccttcagaggtatacatacctgatttctttagggaggtgtgaaaaagaattaatcagaagtcatctctgagtgctactgcagaaagagctctgcctgcccacaaggttttccagccttaactgcttccagagttctgctgatcagctgcaggggaatgaagcagggactggcagggaaggaacccttcaactgggttcaccttttgctacctgcctggctacagaactaagactgaagagggcacagatcctcagtctctgggtttctgaagtgaaacctgcctggcaggcaaagctctggcttgatgtaagggctctgggcttggaggttggtggtgcttgcgctggggcttcttcacctctccatcccaagaaaaagattcacaaaaccagggaatattatccaccagcagtcccatctgcctatgttaaaacacttgggagtcttctgtgcaaatgtgggggctcccagcctgagagctggtctcgtatcaaaaagaaagcaaggccagacgccagctccaaacccatctgttccccaagctcgaggtgcaggtgtgagatcatccccacaaacctcacctgcctgcagtttgtcacctcgtgtcattaccacaggcagagatgcaattgaggcttttgttttacttcacaccagggggaagtcatttttggagtgtttcatcttaaacagttttttcttaaatgtgtgtgacacatattcctcataggacttaataaaatagatatttctcatgcctggaaagtaaactacagctgcacaggttgaaacaaaatttatttttaaaaactaacattccagttggattcattcaaaatacgtttagctataacttctgaaaaatgttaagcaacaaaaataaaataaaaataaaactgctaattaacaggacaaaaacaatactaacaaaacacacacttagtagtatattttagtgtctctggttacctcaagaaaaacaatataaattttcaaaatagaaaaattcctggccgggcgcggtggctcacgtctgtaatcccagcactttaggaggccgaggtgggcggattacctgaggtcaagagttggagaccagcctggccaacatggtgaaaccctgtctctactaaaaatacaaaaattagccgggcgtggtgacgccccagctacttggaaggctgaggcaggagaatcactggaaccctgtaggccgaggttgcagtgagctgagatggcgccactgcactccagcctcggacagagcgagactccgtctcaaaaagaagaaaaactcctaaaggtctatatacccacaacattaccataacggaagcaagcagaaaaaccattttttttttttgttttgagacggagtctggctctgtcgcccaggctggagtgcagtggtgcgatctcggctcactgcaagctccacctcccgggttcacgccattctcctgcctcagcctcccgagtagctgggactacaggcgcccgccactacgcccggctaattttttgtatttttagtagagacggggtttcaccgtgttagccaggatggactcgatcgcctgacctcatgatccgcccacctcagcctcccaaagtgccgggattacaggcgtgagccaccgcgcccagccaaaaaaccattatttttagagtcttaaaaatctatcctgaacctgacatttctgtgagaatggaaagaggggatgaataatcataactacaaagcttctagctgcaattacaatgattcattataaatacaaataaagcaaactcattttcttgcaagagctttggttgaattgtagaagaggaggtattcttaatgtgacctcaatgcaaagaacataggtttttcacttggttggttttttgtttttttgtttttgttttatatatatcaaacatgttccccacccagtaagtgtccagcagaaataaaagcaatgggaatatggttttcatgacattctcagatgacttccaagatcttgtcacaatcgagactgttaaaatgacaactaatctctgagactccataacctccccagacacggtgtactaaaaggatttggcttgtctcgtctgtcctgattatgcaatatatgctagaagcagaagaatggtgacacggaccactgggctgtggacaatgttttctggccctacttgtttcatctcctcatctactattttgtaggttgctctgacacttgcagtaagatgaaggtggacataactccaggcaagagcaatgataaatgtttttgccttgtctataaggtaaagaatacaggagggtacatatttatatagttggtgggccagcacgtgagtgcacacagggacacacacatacacacacactctccctttcatatatctaggcactcaatatgtctttattggcatagatatatagatatgtttagctttatacaacagacgttttccttcaggttgtgatcagtattttgcaactcaaatattcaaagggcctagagaagccttactatttaaaagaaattttactcctttcataaaccactatttgctaatataggtaattacccctaaattatccaagtttgtatttatatattcagaaatgcatgcaaacccaaacaaagagatcacagttaaactacctttggaagtgtcctcagtaacatttcaccttatgggtaaacagatgaccaccactaaatggcaatgtttgagataacagatatcagctagatactgttcaaacaacaaaaaatggctcaaggattactgttgggaagagaagcagggaaattcaacataatgtgccaaatgccacacccaccaaatatctaggggggctcctatacattatggtgattctacctctcaaagacataccaagataaatcacatctgtccattgggattgacaagtgcttttttcttccctattagttctaagacactcaagagagataatgttattcactttaccttatgatctccaaggaaacaaacacttcagatgattatctctaacttgccacccccaaaccctcaaagtataaatattcagtgtaaggaataagctaccatgaaaagaaattataaggaagaccctaggaaattatataataatgatatataatcagcaagacttacactcgtttgaccagcctttgaaaagcagctgcccaaattaaaggacttaattaagaagtgtagaataaagcactccaaaagcaaagtcaaggagatagaggaaaagagccctgcattgtgttgaaagaacagctaaactagattaagtacagctggagtgtagggtaaacatagatcagatatggtaagctgtctaaggaccatggcatggaaaactcaaacgctgtgcaaagtttgaaaagattagtagcatgatcaaaactgagctttaggtaaaatctccctggcagcaacaggaaggatggacagcagtaggagagattagatatggaatgtttgtaaggatactactattcaaagagttgaggcaggcaactgcaatggtcacagtcaactttaatatagcaggtaagaatgagggtatatagatgcagaatccctaagatctgggatctaaagataagtcaatgatgatagagttcagcctttggtgatgagtggcggatccattaacataaattttggacataacacaatccaactaatactctggttaaccataatagggaagaggttatttccccctttctttttagcctaaacttcctgctatatctgtgcttcccacatcaagatttgtactactatttattggctttctatcaggttctgactttgaagaactcttctcctaccaagtaaatagttagtggttagcaaaaactggtaaggggcattatctttcaagtaagacagagtaactatgccttacattcttcgacacaaagatggaacaatctcaaatttggatttctagcacagctgaataatgctctgtaaggaataaactaccagccatgcctaaaatattggtcttttgcttgaagttcttcatgttttaactggaaagttaaaaacaatttcccaactgcctatttgccccttgtgtttatttattatttttcatgtttaattaaaaaacacttctactttaagcaaacatttcccttttttccctttaattacctgacaaacggtagcagagctgcataaattttgcctgaggttaaagctggagtaaagcctaatcactagcttgagacattgttctggccaagtaaagcagaacacatttatcccccgtgtttggacaatacttaggcacttccattaagacctctttttaaccagtgttgattctgatgaaccctctttcctgatttatgtgggaaatctgagtgttcttcacaccaccacttcaagatgaaggaaacgaagctcaatgcaggggcatgtaggtgtgcacgctctcttcagtagagaatacaaacacaggccagttctgcgctgttaaataccaagctgggcagccttcccttgactgaactgagtttgttctagacaaacctccaaatttttctgctgccttccataaaaaagatatacaaagtataacaatgacagcagattttaaaaagtcaagggaaaacaaggataggtgaaataaatggcaaatctaatattaaagcaattagaaatataatctaagaaaaactgggaaatcacggcacttgttaaaaaattaatctcaagggcaaacaggacacaatacacacacacaaacatggataacgtgtgctttttcttttttccttaagaggccctactccaaactgggaggctcaggcccaagtatgtagtcttacatgtgcggtctaaagatgctcaaagcacttttcttatcctataattcaatctagtaataaaaagtatggtgctctggaagagtgaatttaaggcagctggtaggtttcactggaatcaagtgatctcatctgccagccatctaggactccccaaagtttagaaggacttttgtgtcactggccatctctctccagcaactgacaaagaaaaagaaagtggagagggtgaagaggcagccgcctttccatttaggaaaaccttcctgcattccagctcacttttccatctaaaatatcaaaattacataggcagaacactctgattccaacttaaaaatctctttgacttgagtagctggaagggatctcaggtaacaaacacccttactcaggtagccatttgcatacacacacaagagactggtgtagatttgtgctgtaaggaataagaggatctagaaacactgctgcctgaaccattaatgttctcctctcctcgcaaagtaatgtcccaccctttttagaggcaacaggctgccatttgaggacaactttgtaaaatctaaaggtgataatgatgatgatcatgatggcaattaaaaatagtaacagcaattaatcatttcttatactgctatggatgtctggaaaatataagggtctagagtcagaaagatcccaattcaaattcaaacatcttggacaatctgtttaaactgagttcccatttcttcattcaaaaaataaaaaaggtgaagaggcataaacccacaaggctgatgtggagataaactgagcagtattgatgaaagcatctggcacactgaaggtgtttctcaaatactccttcattcctctcccttgccagagtatggtttaacgtgccttaaacaaatcagaaagaactaggccagcaacagaagtagatccaggatttacagcttttgctcatactggagacttttagtcactcaataagcatttactgagttttcagtgtgtgccaggcactgcttgggacacttggcatatattttctttaatgtctgccgtcttgaaatttgatttacttttatgttttagggtcagggattgaaagcaaattttctcaaaaaggaagcaatatgacaatgtactcatctcattcatttgatgcaagcatggttcataagcattgtttgtgttgttagtctaatgccaagctaaaatgtcatagaaaaggcaggactggggaagaggctggagatggaccaaaattaatacaatgtgaaattgcaagcaaaaatggcaagcctgcaactgcaactataaaataaaaattaaaaaaaatttaggccgggcacggtggctcacgcctgtaatcccagcactttgggaggcggaggtgggcagatcacgaggtcaggaaatcaagaccatcctgggtaacacggtgaaaccccgtctctactaaaaatacaaaaaattagccgggcgagttggcgggcgcctgtagtcccagctacttgggaggctgaggcaggagaatggcgtgaaccttggaggcggagcttgtagtgagccgacatggcgccactgcactccagcctgggcaacaaagcgagactccgtctcaaaaaaaaattaaacccaaaaacgaagggaagggagagagaaccggtttggaagtttaaagagaataccaaaatggaagtccacaatgagctgcatgagcttaagtgtctctagagatgacatttcgatcacaggcaaggagctcatgattcataataaatggtcaaaaagtgatggccattattatggtgattattactgtgtcttttatctgagtctcagttttctcaagcatcaaaaaagttcagactagatctatgaattttaatggagaagagtctgaactagtttttactgttgttgttttgagatgaggtctcactaagttgcccaggctggtctcaaactcctggaatcaagtgagcctcccacctcaaccacccaagtagctgaggttacaggcacgtgccacagtgcctggaatgaatttttaaaaaaaattcatttaaaggagtgaggcattttttaaagcggttaagaagtactttagctagagaatactgcagatctcttccatttcttacatcctatcttaacaatatactctggcttcactggacctcagaaccttggcaataaaaaaaagtcccttcatctcttatccccatcagaaaatcaaacaagtaatctaacaaaaattagtgaacaaaagagggacattgcatgaaccaatgacaaaactgagtcatgaattaagaagtgaggtgaagtcaaccctctgcatctgtatttaaacaaacaaacaaaacctataagctgtctgtacaacaaacggtcaaagaaaaaagcaaatagtagagatggtatttgacagattttattaattcaggtataagattatggtgtatccatttctatttaaaaaatactagttggaaatgtgtcatcgtttttaataaagtctaccatagcagcagaaatgatgccctaatgtcagcaagcataaaaggaatcattaataagaaatatgcagtccaggctgggcacaatggctcatgcctgtaatcccagcacactggaaggccaagctgggtggatcacctgaggtctggagttcgagaccagcctggccaacatggtgaaaccacgtctctactaaaaatacaaaaattagccaggtgtggtggtgtgtgcctgtaattccagctactcaggaggcagcagaatcacttcaacccaggaggtggaggttgcagtgagctgagatcatgccactgcactccagactgggtgacagagcaagattccttctcaaaaaaaaagaaatatgcagtccaaaccaatatccacagaaattcaaaagatcatatactattaagactacctttatgtttcatgccagtaggtacccataccaagcactctgaaaatatcatctcatttaatttccacaactctgtgagatatgtattttttttttatctctaaaaatggcaataggccaggtgtagtggctcatgcctacaattccagtactctgggagggcaaggcaggaggatcacttcaggtcaggagttcaagtccagcctggccaacatggtgaaaccccagctctactaaaaatacaaaaattagctaggcgtgatggtgggtgcctgtaatcccagctactcaggaggctgaggcaggagaatcgcttgtgcccaggaggcagaggctgcagtgagccgagatcatgccactgcactctagcctgggcaacagagtgagactgtctcaaaaaaaaaaaaaaaaaaaagggctgggcgtggtcgctcacatctgtaatctcagcactttgggaggccgaggcaggtggatcacctaaggtcagaagttcaagaccaccctggtcaacatggtgaaaccccgtctctaccaaatatacaaaaattagctgggcgtggtggcaggtgcctgtaatcccagctactcaggaggctgaggcagaagaatctcttgaaccaaggaggcagaggttgcagtgagccgagatcgcaccattgcgctccagcctgggcaacaagagcaaaatttcgttccaaaaaaaaaaagcaataataaggcccagagaagtaaaaggttttgccaaaggttatattgctaggaagcagaagaaccaagattcaaatgataggtttattcagctccacaaccaggcttaaataactatgcctttcctctcattaaaagccaccaggaaaaggtacttcccaagtgggaagcttgttactctcagagcatgtcatattttattccatactgatgatatctgaatattaagactcagtaaggttactacggtcctagaggaaaaatatttctcacaaatagagatcatgttatataaacaagtggtcttttttgaagttgacaaacaactgttcaacattaaaatgaaacaggccaagtgtataaagggaaaaaaaaaaaacactaaaagtttaaagtggattagtattcaattaatgaatctgaaaatcaaacagcaatgggaaaacccctaaccagggcaatgatggcttaaaaggattcaagtaggccaggcgcagtgtaatcccagaactttgggaggccgaggcaggagcactgtaatcccagaacgttgggaggccgaggcgggtggatcacttgaggccaggaattcgagaccagcctggccaacatggtgaaaccccatctctactaaaaatacaaaaattagccaggtgtggtggcacgcacctgtaatcccagctactcgggaggctgaggcaggagaatcacttcaacccaggaggcggaggttgcagtgagccaagatcacgccattgcaatacggcctgggcaacaagaacaaaactccgtctcaaaaaaaaaaaaagaaaaaaaaaggattcaaggaggaaatagaatgataaagtgataaacagcaacagggtctgcaggcctctgaaattttgatattacttttatactctagatcctgttgttcttggagtggcaggatgactacagttatttgtttgctttaataacttaataatgcttaccttttatctacagagaaaaaaaaattatttccaatgcaaggcaatgatccagaagctattggcttcttgaatgaaaattaactttcttttgtacagattttatatgactataaaacatgccctggcagtcagtgtcttagctacctccacaagagtggacagtgtaaacagcaagaggttacaacatatcaggctaaactgtagaagttgcaaggagcttgggaaagagtattataattaagaagaacccagcagggcgtggtggctcatgcctgtaatcccagcactttggggaggctgaggcagatggatcatttgaggtcaggagttcaagaccagctgggccaacatggtgaaacctcatctctactaaaaatacaaaaattagccaggtggggctgggcacggtgggtaatgcctgtaatcccagcattctggaaggccaaggcggacggatcacgaggtcaggagatcgagaccatcctggctaacacggtgaaaccctgtctctactaaaaatacaaaaagttagccaggtgcggtggcgggcgcctggagtcccagctactcgggaggctgaagcaggagaatggcatgaacccggaaagcggagcctgcagtgagccgagatcgcgccactgcactccaccctgggcgacagagccagactccatctcaaaaaaaaaaaaaaaaaaaaaaaaagctggggtagtagtgacatgcccgtaatcccagctactcaggaagctgaggcaggagaattgtttgagcctgggaggcgcaggctgcggggaggaagaggttataacaacagtaattattaagtattgtaccctcctctactatatattaggcttcatactagactctgttttctaacattacctcctattaccctaatacatacctaaaataggcctttctttttaaatagaagaaatcaagacacagaagttaagagacttgcccacggtcagagatcagttattcaaatccaagtgagtctagatgcaaaaacgcagccttttaaactctcagtggtatttaaagtagggttagtacagccatctagagtgaactagttagtttcccccagtatggcctttaaggaaaaaatttaaaagagaggcagaaagatggcaatccattaacaacttactgggaaactgcctgaagcttattgaaggctgatttctggaactggaacattttaaaaacaccaaagttgttgtcatttgcccaaacgtgtcaaatgcaataaagcaaattcacatcagatttttttaaaagctgtgtgacaagtaagtaaagattaatgtggtgttgaataaatggaaatattctagctgaaactattgtagttcagaaattattatagtcaactatgtggaacactaaaatctaatcaaacgttccaacatcattactattctataaatttgaatatttttttaagccaagaaaaattacagaagccttgaactcaaaagttcatactatgaattgaacttaatattatttaggaagtgcccccttcaaattactgtaattggtcaagtagtttcaagaacctagaaaatggttttgtctcatcaatgtaatgtcctcctccacacaatgattgaaaccatattaggtctctactactccaagctatcaaatcagtcttcttcatactaggaaattgagctaagtttcctgaatagaattaactaagttgctttgttttatttacaagaaccacagtaaatagtttattaaaaaacaaacagtactcttattaaactctcttcagtgactttctaaccaacaaattctttttctaaaatagcaagtagaaaagtttataggtcaaacattatatataaaatagttctatagtgacatgtaagaattacacctgccaggccaagcacagtggctcatgtactttgggaggccaaggtgggaggatcacttgagctcaggagttcaagaccagcctgagtaacatagtgagatcctgtctctacaaaaaaaaaaaaaaaaaattaaaaaattagccaggtgtggtggcatgtccctgtgttcccagctacctgagaggctgagataggaggatcgcttgagcctgggaggcagaggttgcagtgagctgagatcacaccactgcactctagcctgggcaacagagtgagatcctgtttcaaaaaaaaaaaaaagaattacaactgaaatgtgtaacttaacaaaaacaatttaaaatctactcagaaaaattttgattgccttcatgttgataactatagtaacatttggtatccaggaattatttcttttttaaacaggtgatctttgactacccagaaagcagaactatgaaagaagagaaatctcaggaagtaacttcaagctctgcccaataaaaacattcactgactttctctaaaggtctttttccttctctgtggaggtgattttgaaatttcattcaaatccctaacagctcctatcaaattatattagaattgtgaccttataagatgcctacagacaattataattaatcttagtttgtagaatggattaatgaatacattttgtagctctttgcatagattacacatatgtccattaatcagtagtgagaatctaaaactaattcctggaaaatctacaaaggaacccaatggttaggagtgataagaaacttctgacatggtcctttgataatcagtcataaaaataggctgtgaccgctaccattatcactaaggaggtaatgtgtctaacgacagtgaggaggataatatactatttattgactcttttccctgaagtgttaaagggttttttttggttggttttttaatgtttggtcattttatgatacaacacacaaagaaactgtaagtctaatgacagaaattaaaagacttgaaacttctggaaattcaaaggtcccttcttttgtggccctggacaaagcttgtttgtatgccttctttctaaaggccacatatatgacactctttcaagtaaaatctactacaagaaaataaagggagggaaaggcacttgcctgtcctcagtcacctcctggccctgttctcccaaactgttatctccttgataagcagtggtgctctcaggtgctttcatattctcaatgctccagcaggagtgatgactgagaggcccccaggcacctcgaaccaatgctgtcacttctagtcactgctaggcccagctaatgccatgcctgtcatgacaagcaccagccacctaaaggcaccacacctctgcctcgacaaaacatacctctgaaaaaagtatgagccacagagggaacctgtttcaggggttgccaagggaagccaaacttgtctataaacagcagaggcacagtgaaagagaacccaaagccacagatacaagaggactgttagcctggagtgcaaataattgttctacttcctgtgcatagattgtttgggaggggagggggaaaaggacatacgaagatacggtttgaccaggctaaactgggtttagttgtcagcctaaacctgccatctggtgttaagatatagcagatcacaccccagatgtgttccttcaaacaaatcacatcttttttcttacccctcttttttttttctttctgtaaagagagaggtgcctgccaaagatacgaatcagtggaagtttactttatactaaaaattctcgttaatttactcagccgaatgaggaggtatgtcatttatgcactcacagcccaaatgcaaccacttttcaaagatggtacctagagatgctgagctgaaaatcatttattttctactcatcaaccgtcaaagttggggctatccttagtcacccaaaagccatttcatctgaaaatcaaaatttatttcagtacagtagagttctgaaatccctattctcctctttatttttgtctcaatatctcattccacaattggggtggggaagggttatgcagtgctatcatttgcacctcattacacttgggctggagctttgagaaagctgatattccctctaaatttttacagatgcttctagtttaccagttcatgactgcactactagaaaagacttcctgcctctaaactgcttgctggcatgtatgctgaatttcaaaatccctgaaaaaagtaaacctttgtggtgttctcttaactttcttcctggggaggaggaggaggggagggtcacccaaaccaagcaaaatctttttctcctatggagtgagactaaagctcagaaacattccctcctaactactggctcttcattttgatttggaaatcacttcacaaaaatgttcattaactgaacgttatttgtggaaggtgtttttcattagaaattatgattgtgacatgttcattaaattgtgaaaatagttcaaccacagacagtctttcacctgagcataactgtattttttttttgcatgtgtcatttgaaaaacactttggacagagagaagggacactttctaaactagcaaacccctttgtttaatggttccagggtttttcaaagttcagggcaggtgacactggtctgttcctaatctttactgtgttagcaatgttaaggctgatgacgagggacacaaatcccctgatggaactgaatgcattccaagctccccgacccactcaaagccataatcccctgcagctggatcttacttaccaccatgcacagctaacacattttttaaaagctagtcactggtgacaaatgtaaactggacacaacagcccccctttctccttacttcactcccccccgctcaatcttcccccataacccagagacttgctgtttctgtgatggataggacctgccttttagaaccaccaagcctgtgccatatagctctgctctaagtaactagaaggttttaaaagcatcttcagctgtcagactgtaacaaaaacaacaaaaaagtcatccttaacacaaacatttcacaactgagaaaaccctctaagttgcgattatcactgccatacggaggtccactatttatttagctctcacatgcaggaaaactgtctggcactcttgctgcttgattaaattaagctgcttgccatattcttgggtataataaatgcaaaagaaaattttaaacttgagattcttttctatcttttggactcttttactttttacttttggcagaaaaatgactgaaatatagtaaacaagtagccctttatggaaggcaagcatgttttcaccatggattttgatcatctacttagaaagggaaaccccaataacccaagtggacaatagctctgtgctggatcaagtctccaaatccagggcaacaaactatggaaaatagcctaaagacagatgaaatgatggatggatagatggatggatggatgatcgatggatggatgaatacacagagctatctaaataagaaaaaaattttctaaatgctatcaaaattccatataatacagatgacagattttgatgaagggacaagctatccacttcacctgatgcagaaaaaccaaaggttaatgtatgtaacttttttggtttattccagttcccagataaccagcaataagtgctatgatttaagcgatgttaccaattagacttggagatagctaccacagcactgactataatgcttacattgcattaggtttaattactgtaaagttacatctggagaggaaaacataattttataaccactctcagcattctaacttgtgctcagtctctgcacgatacatatttgcccaagtaattgaagccctacaaggcaccacagttaataatgtgtaactaggagaaacacatggaaaagcgacaagcaggtctctgtgaattaaattcacatgtaattatgtgacctttcagtgttcttctagtcttcctgagagcaggtactccagagcagctgcgaccagcctcagtgggacccactgaacaggaatttgactgagagtggaggaaagaggtattgtactgatggagaaagatgaagacaattgcttgggtgagtccagctctgattctcctacttgtcactcattgtcatattcctagaatccggagaactcagtcaacacatgagtaattcgatcaaaaaggaaaactataaactttgttgttcatggtgacttaagtgcattgggtctcaacctaaaaatggggtgcgtgcaaaggagtggaatttgtgagtactggtgaaagaacaagaaaaggagattaagagattctatgtgcacacgtgtgtaaaagagtatcatggtacatatgggaagaagtgtgaaacatgtatagctggctacatttttcaagactgaattacagtacaggaatacaaaaacaaaaaagaaaatgggcccctataatttataaatctcagactcatgattaatggcaacatgtattttgtttgaatccatatgatatgcccattcatccaaaaaacatttattgaggcatgtctgtattcttcataaagtgatcaaagatggcagtgctttatagaattaccttatatatccattataaactgaaagcagtatttctactactaacactaaatgatctcaggtctaaatttccatgtctgcaatgatatgttcacactataaagtcatccaaaatcctacacaaaatgtaaaaagtacctcaggaaaaaaattgacagacataaccagacatctgcatgctacttaaaatgtgataaaaatggagtagcttaatcaaatcttttaataccaaaatattctataactgtgcccaaaaaaaaatcacaggttcaaataaatttgtaactaatccagtgagaaatactgattatattttatagaaaaaccacagcaaacaacacattatatttacctgaacttccaggtatcaattcataatacttacaaaaccctaactgaaaatgcttagtcttgagtaagcataaacccttcccatgaaatgaatataaaattaatactgtctctttaagttacaggacctgctatagttaggtagtatgaagccaagaatacgttctgaagcttaactctcaggagcaaacattttctacttgtgaagtaaactctgttgaaagacagcagactacggtcccaccagtaaaaacaggaaagttttcagccagtgacagctttgcctacagagaaaaaaaaagtgtcacagactcactttattaaaccatatgctcattgccctgtgaagaaagcagggtcactaattagttcattctgtgaaagaagcccttcctgatcccgttgacttttgtccccctggttagctccagctatttctgtcatgcaacttgaaaatcactggagggaggaagatcgccataacaaccgctgaaatgatcttgtggaatgtgtctagtggcactggaataacctgaatatgtgctccagatgtgtcggctgtcaggaaaaaagtaaacacatctgatggacagcgtatgactagatggccccgaagcgactccagaggctggggcgcgggggagaggccgcatgtgtgagcaggggggcggcggggtgggctgggcagagcagaagggaggcgagccaggagccggcacgaggcaccaggggacctggggcctggggcggcctgggaggactgagcgcgactgttccgcccgcgtccctcccctgagtggcctctgcgggactgcagcggcctctgcgaatttccgtctggcacggacttgtgagcattagggagcaaactacaacatgaatgctgaggaagggtagaagagaggagcgggctcaaaacgctttctgtcttaaatattaatggcaacatgtttttaaagcattctatcttcagggtagggctgtctcctggcccctactcaccctttaccaaatgaatggttttgcttttttgttccatatgcatactcaagcactctttttattaggtgactgggtgattacattcctgatccgaatatgttgtcttttttgatggtggtggtgttccgcagactttcacaagttggacaagtgggttggttccctaacccaaaacattttttaaaaatatttttctaataaaatacatagaaatgactagaaaacacgatataggccaaaacacattctcaccttagttcctattctcaggggtgtttgcaaagaggaggatttagatctatgcccagtgctaacattcacaaacaaaacggcaattctacaaacatcttaacgcacagtaggcacttgttaaatatttgctgatcaaaatatttttaatgtacaaaattcaactacaaatgctacttgggttctacatataaacagtggcagggattacttaaaaaaataagtaaccaagcttaaaaatacttaagaaaaataaataggaagtttatttccccaggggaacagaaatgcccccctaaagaaaatagaaaacactatattcacactataggacacaaaccacctacttgtgcatgaatccaccacattttaatgcctatttctactccaatcatttgtagaatgggccttacttaagttttagagactatgtataaaaatattcactacatttctgctataaatgcttatatctgtgaaaagcctagaaggtctgtaaagaaatttacaatctatgtgaaaagcttttgaaacaacatattccatattttctttcaaaaactccacacaattatatttcaataaaatatctaacggttttccaacatggtataaacaaaaaacaaaactgcattggagggcaattatctctataacatacacagttatcagcttggctaaggcaaggcagtattcacctagtatagctgtccctcagtatcagggtggtacggaatggttgcaggtccctctgaggatagcaaaatcttcgaacgctcaaatcccttaaaaattggtgtagcatttgcatataacctacacacatcctcttatacttgaaatcatccctagattactaatacaatgtaaatgctacgtaaatatttgatatactatactgtgtaggcagtaatgacaagaaaatattctatactgaaacatcagcaacgatgtaacattttctggattttttcgcattatttttgatccacggttggttgaatctgcgggcgcagaaaccatggatacagaaggccaactgtattttcattcaaggtgattgccaacttacaaatcttgtttccatttctaagtatctaagtacatttttctcctttgataaaactcatttagtgactcagattctgaaagtagatcaccaaagggaaacagaaaaaagaaaaacatgaaaaattattatttgagagcaggaaatggaagaaatcttcaacttactctttactctgtaattcacacatttaacctggcagaggaataccctaaggattcttggaggctgaaagacttaaaatttgaggaatgaaagaatagcaagggtgaatggcactgcttctgccttctagaaattggattccactggcagctggctgaatgaagccagtaacagattcatggtcgtggaaaatgtttcatcctctcaacgaaaacgtcattatttcctcgtaacagaaactgtacttcctgacaagttagacaacctaaaacaatcagtgtcaaggtccaatatataaaatctgttggcaacctacaaaaaagaaataatctgtgtatttgcaattatttgcagagcctactttattattattccagtctaatctacctccactcccaaattaaaagacttcaaaggggctaacagatttccaaataaaatgccaaacatttaagccaaaattatcaatgtgcacatttgcacaatgaagtgccaaatgtctaaaagatggatgagcttcaatgaccattttcattcaccttgatcttggcattcaaccaataagtaaagagttcacgtatattcaaagaactggaatatatctgtattcacttgtgtgacatttacttatttaaaatttcttaaacagaacttgcagctaacttttatgagaaaaatggcaaataatgcgttgactctcatgtcaaattcaaaataatggtttttcagtgagaggttttcttgtttgttttttgggctttttgggggtggtgcaatgttggttattaacagcatcacaaggttagaatgaaattaaacctggagtcagcataggaagtattcaagttccaagagttataagatacccatatgaacagatttggtggttgaactcgacacacttctgtccttaatctactgtgtgttttaaaaactcaatcaagtgctcctgggttatggttcctcaagccaccaacttttcttagacaatgtcacaccaattgcatcaagctccatagagactctccctaatgcttttctgttttactccactgagcaaataatggcaatggttataacatgcacaggctattagatttgcactcctatcaaccaagatctaggaaactttgaagagtttacccataattttttgaccttatctacaggtttacagaccagccataactatgaagttaaagaaagccagaaaagttgaatcctcaagcaaaacaaaacaaaaactaataggacaatcagcaagccaatctattagaattccagctggctatgagtaaaatactgcaatgcagcttcctggatgtaggatatttcaacggtccatttagtaggtttcattcatgcgcccttattaaaactacaaggtagtcttcaaaggaaaaatatgaaactattacatgtagttaaataccagtagaagagaaaatctagaaggttctttgacgtcatcagtcatgtgtcatgttatcaagggaaaagaagccatgaagcacagaattccagagaaaaccaggcaatctgtgaaacagaacagagaacacaatatgttttgcccagttttagaggcctagaagagttcctttcaagaacatagctacaagacttgatctgcttactatcatgtcatcagtgtaggcaatagatgacattaatttctgaagacctccaccccactcgtgtcctgactgtaaaacaagtgaatcaacgaatccgaacccaagttctataataaacacagaatattctctcaagggtctgtgaaatcctcaagacaaaacatacagcacgttaattcccaaaatacatatttttccatatagcatttagaggtagaaggagaacaaagtggtaagagctgaacaaaacctgagaaaagtccctgaatccaaattccttttttttttctttttttgagatggagtctcgctctgtcaccaggccggagtgcagtggcgcgatctcggcttactgcaacccccgcccactgggttcaagcgattctcctgcctcagcctgccgagtagctgggactacaggcacgcaccaccataaccagctaatttttctatttttagtagagacgaggtttcaccatgttggccaggatagtctcaatctcttgacctggtgatccgcctgccttgacctcccaaagtgctgggattacaggtgtaagcccccccgccctacccaaattccttcttattacagtccaggaatcagtcttacagaagtaaatcaattcacccaatgttgcgtttatttgtatctggagaagaattagaacaaaaccctcaggaaagtgatatgcttcctacaaatccacccttctcttgccaccaccaatttcgctccctcctcccaagtgacaactgacctattcatcagacgatgaataagatcttctcttagaagcactctgccttcaaagaggaccaagattaacaaatccaaaaacactcttcttgacaatttcaaccttctgtccctgtaagcattttaccaggatcgtcaaaaagtaaagacccactttgagtctgaactccattctttttccatttcctggaacagttttctcaagcaatgaaatgccaagaaggaagagaaaaaaaactagcttgggaagccaagagcttcgaggtcattagcctcagagcagtaatggttgactatattcctttatggttcctttagccttacttcactaagggcaaagagcaatttttttttctctctgatgtttttcaagtgttactgtccttgcaggcccattatgggggcctcacatgctgggaattgctggttatttggccacttgccataaggaattattactactgcacttaagacaaatggtgtccctgactccagaaggaagaccactccaaagggaatgacgggtggctaagcaagcccttcaagaaaatcatgtgaactcaaaccctgcttaaaacctcctcatttcatttagagtagtaactcttggtccttaacatggcctcctagccccttccttcccttcagtctgataccagctcaccagcattactctactaggttctctcggaaccaattacaatggcctgtccacacctccaatgtcccaagcaagctctctctaatctcaggccttcagtccttttgcaatactcagcaccctctaccttgccctcagacaacctagttaatttctctgcatccttcagatctcagctcaaacaacccttcagagaaatcttctctgaccccacaaactccagttggtggtcactgctttgtatttttggattctgagtaatattctatctgaaaaatgaagagtggtctcaaagctcaaaaaaactttgaccatcactggccagtcaaaaaaaaaatcccttaagcaaaataattctgatatttgtagtatttaatttctactcttaactatactaataaaaaattcagtgttacagatttttggaagcaaaccccaaatccacttgttggggtcaatgttcatttatttcaaacactccaaaaacagatcaatacttttgaaaactgtagccacttaatactcctcctttccctgtgttggtagcaatgacagacagttgcagaaaagcaaaaaatgcaccaggcttagagtcagactataagtcagaccttgctattaccagctgcctgaccatagctaaatccactaccttctctatgcccagtcactcttctgtagaaagaagaaaacaatgctacttccttagagtactcaggagacatgcatcttgaagccaatgtttgccttccacaattagcattttacatttttgcctgattatctaataataccggtctcctcacccatttgtgaactccctacaagtaagtgatttttagtcttttttctctatcactgaatccccagagtctagtataatgtctgtcctatatatagtaagcactcaacaaagagtttttaaataaatggattaagagatagtgcagtatgaaaacagattcccccatctccgcatattagttttgcttttttttttaagtgagatgttaataattctacaaagggtaatacatcttcagcagtctcccctgtgtatgactagttactattctttcatagaattcagtgttcactgggatccagtcggtcatggatatccacgggtacttaagaaaagtctagtcagcgagtttcattcacttatagtggcttcattcctctagtatcacaaattgttcaaaagaagaactgagttacagagtgttgtgcaaatatcaacactgtccttccacacaaatagagaaacaattcatacagatgagatgttaagaacagcaacttcatataatagcaaacattattcgtcttttctgcatgtcaaaatagtttaatactttaacaactgattgatcttcaatcaatagcattgatttttctttgttaagtatgtttataatcattttacatgtagtaaactcatctaattctcaccactacaaccccatgagttaggtaccattattatccttatttgatagagaaggaaacctcactgcatttgtggttataaaaattgtgtacttggccaggcatggtggctcatgcctgtaatcccagcactttgggaggccgaggcaggcagatcatttgaggtcaggagttcgaggccagcctgaccaacatggtgaaaccctgtccctactaaaaatacaaaaaaattagccaggcatggtggcacatgcctttagtcccagctacttgggagactgaggcaaggagaatcacttgaacctgggaggcggaggttgcagtgagcagagatagcgccactgcactccagcctgggcaacagagcaagactcccatttcagaaaaaataaaaaatcgtgtacttaatatctatctagcagaaaactattgtgtgcaaggcacagttctggtatcctattttaaatatgaggtttaactctcttgccaagaaaaacagatttaagttaaagaggttttagaagaattggcgtctaaagttgaattgttttttcccagacttaccagtttgagacttgctctaataggataaatctttcaactgcagggagtcttcagtaaaacacagcacccatcccacctagttaagaatcctggcactagaaatctatttcaccccactcagcaggctgcagtacataattattttcatctggttataacacgaggtagtgagtttaatctctaaaggcctacagggattgattttagcagttttagaaattgcctctcacgctatgaatgtgcctcacagcaagacggtcctgctaatggttcccagattaggatttgggaagaccaacggcatggcttcctcctcttcataatttcctttcctttgtgggccaagtctatggtcattcaaggtaattctcatggcgctgctttcaaaaacaatttgttctgatttaaatgaagaatcagaggtcgtttttttagggtataatcaattattactatagctggagtcaaacgaatgcatatataaagtagaccatcagaaacatattcttagaaacataaaggggtatatgaaaattaaatagaatcccaaacaataatatggccatgaatgtgaagaaacctctagtttgtcttgatttttaaaactttggcccagctcttcctttcaggagaaaaaaaaaaaaaagaatcctagaaaaccagttcaagaatatatttaatgtctccttgattcttattaagtttgatcctactcaaccaactctcatttgtcccaggttctaagtgaaccctcctcaccacagaaagtcatcagaaatgaagaggacattctgctaatcacgaattttaaagtgaaattgctacaaagactgggactaacaaatcccataaagtaaaaattatctaataatactttttttttcagtttttggtagaagaaccaacctcaaaaaaataaaaaagaaagaaaaatatataggcaaattaaacttcctgcttataaaagattcagaaaaggcccttgggctgtccacagcattgagtgatagcaggccacttatattaacagtgacaactacatgtctaaaaggtattcaacttacacacctggttcaacatatgttacaatattttggctctgccaaaaaaaaaatttaccacatcataaattctctccccactgtcctggtatctcaggtgggggactacataggtaagttctaagagtcaaatttttataagcatagagaagtaacaaaacactttcaaaatgctatcttttcatgtttttgaacccaaaaaatggacccacaacaaagatctcagtaatataaacctgaaacactatgaaacataatcttagaaaaccataattctggccaggcttggtggctcatgcctgtaatcccagcactttgggaggccaaggcaggtggatcaccaggtcaggcattcgagaccagcctggccaacatagtgaaatcccgtctctactaaaaatacaaaaattagccgagcgtggtggcaggcgcctgtaatcccagctactcaggacgctgaggcaggagaatcacttgaaccttgcaggcagaggttgcagagagctgaggtcgcgccactgcactccagcctgggcgacagtgcgagactccatcccgaaaagaaaaaagaaagaaaaccataattctaccagactgggaagtccttggtagactgccaagttcttccatctccagcctcgaagtcgatgtctggtgaagaggaggttctcaaattatatttgtagaatgagataaataaaacctcagaattatctgaagtactttcaaacatgttatcacactgtgatcctctgaaggtatataagacaggtattcttgaaccatttcaaagatgaggagccctaacttcagagctatcaaattagcctggtcttagggctcctaagctactgcttttctattactatcaactctgcctcaacatttaaaaagctcagggtttccaggaggtggaggttgcagtgagccgagatcataccattgcactccagcttgggcaacaagagtgaaactctgtctaaaaaaaaaaacaaagggtttctactctttcacttttgctctgctttctgtattttatgatacctggtataaaaacgccaaaaggaaaaggcaaccagatcattcagatgccaaaccctaacaagatcactactgccctttggagctatgcaagtctgatggctcaggctaccaggtatttaggtctacttaaataaggcatacataatgcgatatttacactgtacacaagtttcaacctaccacatatttttaaccaaaaatgtttctttggaatttttttccatgtacaaatacatactgacagtttaattctagatagacttttacaggaaaaacaaagcaggccaggcatggtggctcacacctgcaatcccagcactttgggaggccaaggcgggcggatcacctgaggtcaggagttcaagatcagcctggccaacatggagaaaccccatctctactaaaaagaaaaaatacaaaatcagctgggtgtggtggcgcatgcctataattccagctactcgggaggctgaggcaggagaatcgcttgaaccccagaagcggaggttgcagtgagccaagagcactccattgcactccagcctggacaacaagagcgaaactccgtgttaaaaaaaagaaatgcgagttgttacctcaaatgttttagttctgtggatgtcactgtaaaaactgatcaccacagaatcacatcacactaccacatatgaactgcataatggtaaatccagtgttttcagattccccaacttagacttcaaagtagacatgatcttcacctggtagctcacagttgctcttaggtaaaattgtatttcaactatggattcaacattatttatagtgtacttattgtatgcgtggcttatgctaggttgggtgattccaacatgagtaaaacatgactcctgacccacagtaaggacaacattaatagtacttgagaaagatacaaagaaatacaaaaaggctattgtattggtctatgtgtgccacaaatgtggttgctacatacagtttcttaaggaacacacgtgaaagaaaactactaatttcactagtcagtagaggtgagctaacagaagttagctcttaataattcctccttgcagaaagagctgatacataaaagtttctaacagagtttccaacatagtggattaaactgttaacaattctggataattttctcagataaaagacactagaaacttaaggattcttttccttaaaagtgaagcaataattctgcaacagtttgtatataatatacatatctgaaagtaatcttagttgctttcaatactgctcaaccaatcataactagcactcgttgctaaggctatgcatcttttaatgccatgtttatattatgctatgtatcaatacggtaaaagttacacgccatcacccattttgtaccagtcttccttctatgtagtactaaaatactgcccaaattactagttttgaaagctatcctagaatagaaataaaatgccctataccaaatattaagcaatgataaacatttaattaactgtggctcattagatgattacctatctgaaaggacctactatgtttgactcacacagatatgcaggttagaagagaaccccatgcaagtctaaagcacgctgcgcactctctagctctcggaccaacgatttcattccttcttaggcgccatcactatatgcctattaggcatccagctctatagcacgtaattctctcccaaaactagaagtacactggctttcagtcagaaaaattaaaggctgattagaagatcctctcaaccttacagccaagaaaaacgtaatttccaatatatagactgaattgaaaaggatttttacaaatgattagtcaaccaatgcggtgtggtgcatgtacctacgtacaaacatgcatgcctgcaagcacacacccaccaccaccccatgacagtcaccagaaactgctaaactaatcccagaactccttccaatgacccaagcaagacacagctgcaggattctcttctcaatagcctttaccaatctatcaatattgataagagttgaaacctgttttccatctttaacttactctttacatctttactgttttacatctttaacttcagataaggaggtctaaagaagtaccaaagaagttacaaagatcaaacaggcagtcagtgacagagtctgggttagaaaaaaatccagaccttgtgccttctggtccataccacagagcctatctgcaatgtttatcacatacccactaaaccttactattccttaatttctctgtgtcctgatcatttaacttcttaccatctcattttggcagccacatacgctcctctcccttttgcttttacagaatccaatgcccctggcataaaaggggagagaacttactgccatttcatatccacgcagttaatgaatgcccatagttaacatggcgtctcccccttaagccactagctgtcactcaaaagttcactctaaagcttgacctttgcttctgctcagaagtatttattcaccctatcacaagtgtttttcctttaatgtcatgatggcaaaaatactgcagtggttgtatgcctttccaaatacgcacatctgtgacaaacactatacagttttgtcactaagactcaagaacttagatggtaagatataccaaaagcaaaaaagaattaccaggtcaagggactgggtaaaattggtattcctatgcttgttacctgccacagaaaccaagtacaatgtttataaacctgacaccaaataaacatttcaatcatagttatttcagcagttctaatgtcaaatgagcctacaactgctcatcagagaagggttaccacatgtatgcactcagattggaaaatatcttcactactctttaaataccataacatattttggccactccacaataaacaggcctaactgtagataatattgtatctaacaaaatcagcttttttgactgaaatcccaccagttccaccactataacctctcagctagggtaattagtattttcgttgttcttccgattccacatttgaacactgtagttctctacttcacgggcagaaatgacctcatgggcaatgttctaggcagataaaaaggtcacaaattaatgggcaaaagagtcctttctttaaacaacacataagcaaatctgaaagatatccaccgttttaatgagtttttgtttgtcaggcactgtgctgatccttacccaaactatgtcttattgaattctcattccaaccctaagcaatgacagttattaccctccatatttaaaaatgaggaaatccaggcttaaagaaattctgtcccttgtcaaacttcccacagcatagttgggattcaaactcaggactccgacgctttctatacctacactgcctatgctacttccactacactataaatacttagaaaacatttgtaaaaatgttgtgaggccatcagaactgtaactaattattcctcaaaatgtagatatcctggctaaactgtatgtccataatcaaaccatcatatcatcaaaagctaatcaaaccagggcataaggtctgtgtgggtcatttaagttaacaatggaacccttatgatccttgagtggtttcactgcactgtggtattcaccatgccttcttataaaatcaaaaatacaaagtttgaaaatgtttaaacacttaaaacgtgaaaaaaaagataaaatacttcaaaataaaagattaatccatgaaaagagctgcatgcatgatgactgcccattgcaaaagatgtatttccgaagcctatgtctgcaagacattattatcaaatttgttttttttttttgagacagagtttcactcttgttgcccaggctggagtgcaatggcacaatctcagcttactgcaacctccacctcccgagttcaagtgattctcctgcctcagcctcccaagtagctgggattacaggcatgcactaccacgtccatctaattttctatttttagtagagacagggtttcaccacttttggtcaggctggtctcgaactcctgacctcagatgatccacctgcctcggcctcccaaagtgctggtattacaggcgtgagccacacacccggcctgcaagacattatttaatgcacatattttttggagttttgaagctgctttgccttatgttattttaacatatgaacctccactatgatttttagtatcttgcaaactgttgacctaccaaactagtaagagaaattcacttagaaaagatgctggcattagaatttccaaaatagttcatgtagatataagtatgatactttctgtttctgtgataggaaaaagaaacgaatgggtgtttggcacttgcattacacagataccatgctaggaattttcacatatgtcatctcagaaacactccagcataaatattattatacctattttatagaaaacagtgggtcaaaaagtaaaagatgctaagggctggggagggagaatggaggatttactgttgaggatagagtttctctgtggagtgacgaaagcgttctagaactaaatagtgttgatggttccacagccttgtgagtatactaaaaaccagtgactatacacttgaaaatggtgaattttatctccattttaaaaactgaacaatcatggcaaacattaacatttgggaaatctggttaaaggatatataggaattcattgtattttttttttctgactcttgtgtaagcctgaacttattttatttttgttttgttttactttgttttttggagtctccttcactctgtgcagtcttgctgcagtgccatctcggctcactgcaatctctgtctcttgggttcaagcaattctcctgcatcagcctcccaagtagctgggattacaggtgtgcaccaccacacccaactaatttttgtatttttagtagagacgcagtttcgccatgttggccaggctggagtcaaactcataacctcaagtgaaggcctgaacttatttcaaaattcaaagttttttaatgaaacaacaatatgaatatatttaacattactgaactgtacactttaaaaagttgagggtaaatcttatctgttttttactataattaaaaatagatttgatagatagataattgactgatggagagatagatgaatttgcccaagattctaccatattcagtagcagaatcagtattcaaattcaggtctttacaactccaaagccaatactctttaaaaagggcagggttataattctgtttgtactagatagtactgagatgtcatttatggtcgttcgaaaggtgtacactaagatacattccttttttgtgtgtgagacggagtcttgctctgtcgcctaggctggagtgcagtggcaaaaatctcagcttactgcaagctccgcctcccgggctcaagcctcagcctccactgcctcagcctcagagtagctgggattacaggtgcacactaccacacccagctaatttctgtatttttagtagagacagggttttgccatgttggccaggctggtctccaactcctgacctcaagtgatccacccgccttggcctcctgaagtactgggattacaggcgtgagccaccatgcccagcctacatattcttaagctccttttttataaatgaaaaatctattaccaagtaaatgggttttagtaaatgtttctgagctactttaggtttaccatgtaagactacaaatgtgtgtggaaggagaagaggtttaggtactacgcttttcatcaaacagttactcccaattgaatagtatttgaaaacaagcagaattcatgttagaattcaagcagaaattcatgttagaatttttcttccaagtcaaaatgccagaactgataatgccatgaggatgcaacgagtatgtgaaatatctgtttttatcaaattctggtttttactcttaggttttttgttgttgttgttgttcatttaaaaatcttttggccagacacggttgctcacacctacgaagcacgaggatagctcaaggctaggagttcaagaccagcctgggcaacatagtgagtcaccatctctacaaaaataataataataaatcttataagagtttagcaatttctcataagtttttttttttacgttacaaaaaaaaattacagacaggagtttcaacacacattttaagtgctagtttaccaaacactgacacaaaatctgatgggtgtttgcaaaaacgggtatatctgggtttgagttgggggcttacgactaaatactattaatataccaactgcataaaatatccatatgcctttacaaatcatgtttacttaaaaacgttaagaagtagaattcagtgttcaatcaagtacacaccttaaaaaaaatcaacattcctttaaaaaaaaaagatgtcaggtggtaattctagggatggggagcaagagtagtatttttacgaatatttttcttttcttttttttttttttttttttttgagacggagtctcgctctgtcacccaggctggagtgcagtggcgagatctcggctcactgcaacctccgcctaccaggttcaagcgattcttcctgcctcagcctcccgagtagctgggactacaggcacccgccaccacgcccggctaatttttgtatttttagtagagacgggttttcaccatgttggccaggctggtctcggactccttacctcaggtgatccacctgccttggccaaagtgctgggattacaggcatgcgccaccgcacccagccatttttcatttttttatatcaataactatccagtcatttctgggaaaggtattattggtatttggggcagaacaactcatcactgtatgtaaattgttctgcaatcctgatgctgcagtgtccctgacccactaaatagcaggaggcagccccccagttgagtcatttgtgacaaacaaaacatcgcccaagatttccaaacactgtgtaggtagtagcatcaccaggttcagaacccaaagaagcctaaaccccctccacctgtcagtacttcacagcgaactgatgagtaggaagttcctatcagtcgggctgggggccaaccttcccaggcactgccaggatgccccatgttttgaaataactttctcttaggcagcctatcagtgtaaattcggatttctatcatgttattcttaaaaccaaacatacctgcattaatttgactgacaccataaaaattctaagagaaatgggcatttttttaaaatggagggagtttttaattattcaacaccagcttttttacagttacagtcctcagaagtcacatggcctagaccatggagcttttcaaatgctacaagtcataatatacgcattagaaagaaaccacggtagttgggttttcaaaataggaaaattggccgggcgcggtggctcacacctgtaatcccagcaatttgggaggccaaggcgggcggatcacaaggtcaggagatcgagaccatcctggctaacacagtgaaaccccatctctactaaaaatacaaaaaattagccgggtgtagcggcgtgggcctgtagtcccagctacttgggaggccgaggcaggagaatggcgtgaacttgagaggcggagcttgcagtgagccgagatcgcacctctgcactccagcctgggcgacaaagcaagactccgtctcaaaataaaataaaaataaaataggaaaattataccaagaatccaaaccccacgttccagaacacaaaatgttcaagttcaatgcctctgcatacttaagttaccatatgacagaaacaatgcagaatttataaaaactaatttagtggcccgggcgcggtggctcacgcctgtaatcccagcactttgggaggccgagacgggcggatcaggaggtcaggagattgagaccatcctggctaacacggtgaaaccccgtctctactaaaaatacaaaaaaattagctggccgcggtggcgggcacctgcagtccggaggctgacgcaggagaatggcgtgaacccaggagacggagcttgcactgaccccagatcgcgccactgcactccaacgtgggagacagagcgagacaccgtctcaaaaaaaaaaaaaaaaattaatttagtataaaattaaaaagagctacgtttgaaatatagttttggtgaatttctaactgtaaaaaaagaaaagatgcttcaaagtaatacattaacttaataagaggaaagaaaatccagcattttcagtgttaaattctaaaccattatcaataacagaactgtacaatcttttcactatttccttaagcaaagcccaaaaggtctgctcattaataagaaaagtcatcgtatttctctttgaaaaatatttgtcaccaattctgtggtatattctttcccaagttctgactagaatcgtgtaagtccaccacgcaacacagcacagcgctaaataccacaatctatcaccagcattaactgctcccagtcctaagactttaatttcgacaaggctgcagctcagaaactgaagactggtagggtttctctttcagcaggcatggacaaggaccacatattttcatacaagctggtgcatatgagaaacagtttgcggccccagtcataagcatatctaagacaggatttctaagtttgtgaaaattctacaatacacttttacaaaagaagccccaaattattttagaccaatccatgaagagtaagtgaccaaagcaccagcaggttttccatcagccacaatcttttgaaaactttgagtaaaaagaaatcctataaaattttgctatcacagcactaggccatcaatttccaattcacagatgaaatatctcagtcaaaactgcaaaggcagtattagtgtataattactggtaaagacagatgtgctttggaaacacccgaaacttaacttccctgaaagtacactatttctgcaaaacacaaagtagataatatatttaaaatagtaatatctgttcacaatgtcaagttgctgcatggtagaaaatgatctctgtagcaggtcctcaagataaaactaaatgtgaagatgtatgctgcggtaggtctactttccaattactagaagtaagcatataagagatataattagttatgacactaggacaggcatacatgtttcaacacacacgcagctcaaaacaaagtttttggcactatatgacagagaacttaaaccaagactcaaagaaaggttatggagtgtgtgcgtttattttttttatttatttaaaacttgccacatcaaattaccttttttacactttaagtatattttgatttgtttaaacatctctctgaagatttctcggggcgggggggggggggcggcgggcaacaaccctgaagctttcactgagcctacattacaaattaaggaagttgactttataaaattcatttggttaaaaaggaaaaaagaattgaccaaacacgtttaggaaattttgaagtgctagtcacaggtttttcaatcaggaatagaacattaaattctaagactaaaatatacaaggtagtataacttaattttgacaattaaaagcttgtccgagatatatcaagatatccccaaaccataaccattgagcaaggctttaaaaactaaaacacaaaactattgaataaatccacaagtaaatcatgatccagttaggatcatttattccttgataaagacagaaaaatgaaaagaccataaagatacacctgagaatctacggagcagcatgtgcggtagatgtgtaaacagttgattatttaaaataaagtatgattaagctcatatgaagcatgaattcaggaaactggagagacaggttacataaatacataaaaaacaaatcctgtaagaaacctgtgtgttcaatctcaaaagactgaaacaagaaatattccaaagcatcccttttctaagtctctgttcaaagacaatgaaacctatgatgcagtagcttatgaaaacacaacaaaattcaaactcttaagatattctaattaggaaacatccaatattaataaatgctgccttttcccttagtatcttatcaaacataaatttcttttgctgagaaaattaacctaaaaacaaattttaagttagaaaggttcaaaatatcaaagtaaagagaaggcaccaaaaaaaggaggcagacttcaagtctgacagcttccatctcccaagtcaatctacaaatgaaattccatcgatgaagtcaggtgtagtgaagaggaggtattgtgaatgggtgctggaaacataaagcttgtaattaagtgcattcttgagtataataatccaccctggaacaagataaagcattcagaacctatccaatgcaaaacagctagacgttatactcccacaggagttacagtacatgacaatgaattatgaaccaaatcccatcttatgagccaaatggtccatgaagacagcacaaacagtccctccaaagacactgttaattacgccctcaggttttggtccagcagaactttacacctgaaaacaaggcctgctaaggaccctctctaccttcataaaacaatgtaggaaatctagcatattagttataaaaaagactttgggatttggttaaaagaaagcacccaggagatttcaactaacacaagaaaagtttgaccctcaagtttacaggctgagcatcctaaatccaaaaatcataaaatgctctaaaatcccacactttttgagtaccaacatgtcctaagtggaaaattccacacctgacaccattgctttctgatgtccacgtacacaaactttaattcaggcataaaatgtaaaaatatacaaaattacttccaggctatgtgtataaaatatataagaaaaattaatgaatttcatgtttagacttaggtcctgtccctgagataccccattatgtaaatgtaaatattccaaaatctgaataaatctgaattttggtcccaagcatttcaaataccagaggctcaacctgtatgtccaacacaggttgttctagctttcttttaaatgagaaaattccagagtttcagagagccccagggaggaatgaagaaacaaatgtaaaattagctttcctggagtcaaatttatttcatttctttttatttcccgaactctcattccccccaccaaaaaaatctataaattttctagagtctgacttcacaaagcagactgaattttcaaaattgctagttatatttttaacaataaaatgattcctagatctgcagattccatgcaaaagattttttttttttttttttttttttgagatggagtctccctctgtcgcccaggctggagtacagtggcgcaatctcggctcgctgcaacctccacctcccaagttcaagcaagtctcctgcctcagcccccaaagtagctgagattacaggcgcatgccaccacgcccgactaatttttgtatttttagtagagatggggtttcaccatgttggccaggctggtcccgaactcctgacttcaagtgacctactcgcctctgcctcccaaagtgctgggactataggcgtgagccaccgcacctgaccccatgcaaaatttgcattttacgctgtggagaagaggttgtatacaaattggaagaagttcaacaacacagatttttccaaagcactaatgcttttcttaattgataaccaaaaagtcaacataaaaaaactgattagtattacctcaaaccataacttgctgaaattcaaaaacaaaccctaaagtacaaaaaaaaaagtcatattcctctttggcaactactttttcctttgacttttgtcaaagaccagtatgaataaggctgtcccacaaacagtgttatgtgcacaaatttgtacttcactagctttctgatttctaatgtcactagtatttgtttatgccccccacacacagatttgctcaactaaaaaaacagactaggtaggttatctgtcaacctctctaatttcttatctaagacctatatataaaaccatttcgtatcatgaagcactcatgcagtctcacatcttagttaaaacttttcttgatatcctttgcctttagaagccttctcaggctccaaaattttacttagaatagaaaaaattcactctacagtagaatttatcaggcacttaaaacatagagctggctacaaagggctacaaaataataacacactttggtcagtggaatgatatttataagcatgcatgtatggtacgcatgaatctataagtgcacaaaatatgataccaattcttatatagtgaaatggctttttatagatttaaagaagctccataactagtgggaggaaagaatcaatgtcaaaattgtcagcttaagacactgtacttcttccaacaatgctaccattgctcaaaatatttctagaactcatcatctgtaaatacttctagggccaacttgtaaactatatgtgaaaaatcaatgttgtcttttttctaaatcaaaaataggctgggggtggtagcccatgcctgtaattccaccactgtggaaggtgaaggtggaaggatcacttgagtccaggagttggagactagcctgaacaatacctcaggaagctgaggtagggggatcgcttaagtccaagagttcaaggctgcagtgagttattattgcatcactgcactccggtcagggtgacagagggagactctgcttctaaaaagtaaataaaaaaaaaaatcaaaaatagaattatcttgttttaacacccaccaagtaagttaacaccaaaagacttttgaagattcagaaaatcaaagcttatgtcatggaagatttgctagcaccaaagacgcttagaagaactagacacaggctgtctgaaatcaatgtaaaatgaagacctccaagagcattttaagctatgacaccatcactgcatcatcttctagggtgactattttataaataataatacttatttgtaactgcttatttgtggttttcaaatttccttagtgtattcattagtatagtaattatttcaatgcttcattcaaatttattaatcctgtcaaacattttaagttcttcaaatgttataaaatctcatttcacttaaaaagtatttaaaatcagtacagcggctgggtgcagtggctcatgcctataatcccagcactttgggaggccaaggcaggaggattgcttgatcccaggagtttgagaccagcctgggcagcatagtgagaccttgtctctacaaaaaaaaaaacttacccaggcatgatggctcatgcgtgtagtcccagctactcaggaggctgaggcagtaggattgctggagcccagcaggtcaaggctgcagtgagccatgatcatgccactacactccagcctgggtgacagggtgagaccctgtctcaaaaaaataaaaataaaatgaaaacataactagactttcttccaaattctaagcataccatttctttattttcctgtgtcttgaaaatcacatgtaattataaaatggtactgtaaaacttttcatagcaatgaattctatggtatgcaaattatttctcaataaaactgtttttaaaaacttaagtcacagatacccaaagaagccagtgaagcatcattaacaagcctgaactattaaaaatgaaggaaaaagttattcaaagattaatcaaaagcccagatcacgccaaaacagaccaatcaagtaataattttttcagtcactgaaagagctcacatacttctcacacatatgttagcacaggtacaaaggaccccaaaacaggtataccctgaactgaagagacttgtaaattccaccagaggatgaatattaaataaaacatatagatatacacattcatgctgaatctcatatataatatttcactttcaactcaacatgagatgtgtgatcttttgaagagtgggaacagattttacactctcacccgcagtcacaccgccttattatacaaaagcacaaaatctgtaaaatagcctgactacagagatacattttgctttaaacaaagttaaccatcctgtccagatcatgctctatccagtctcagtttttttgacagcacaatgttccccttatatatatatcatgcacactataaaacacaaaaataggtgaacaagataaatcaaatttctaatatattttcccccaaatcgtaaaggatgatttctgcataccccttgaagtgtttacatctatcctggaaaccactattccaactgagctaagcataagcagttcagaaaagttcagcagcagatgccaaagaactctcaatggttataataaataagttttgataactattgataaagaatccgttcatattcacaaggacaatcatatgtgagatattcatccattcattcattcaataaatatttgttgagtgttgctacaggtaatggaaatgcagaattagtaagacaaaggaccctgttcttatggggcttcatggtggtgggaagataaactacatgtaaataaaaaaattaaatatactttcaagcggcagtgtgctgtgaagaaaaaaatcagggtaagagaccaaagaaacatacactgatagggacacaggagggaaggttggcaggaaggtctctttaaaggactgacattccagaggagactctagtgaaatgagggaggaagccctgcaaaagtgtgaaaaaaaagaacctcacaggcagagaaaaaccccatgcaaagggctgaggtaggtaccagcttagcaaagttctatggcctgtggaaaatcagcaaggctggattagagggagcagtggcaggaaacggcgtcagagttgggctgggtcacaaacattacatatccttttcagtgatggtaaggagttgggatttcactgcaggtatgataagaagtcactggaaggttgtgagataagaagtgatcaacctgtggatagtcttctaggagtagtgggaggagagaggcaagcatagaagtactaggccacttagaagatacaatagtattctgggcaggatacagtggctcacgcctgtaatcccagcactttgggaggcccaggcaggcggatcacttaaggtcaggagttcatgaccagcctggccagcatggcaaaactccatctctacaaaaaactagctggccgtggtggcatgcagctgtaggcccagttaggaggctaaggtggaggatcacctgagcccagggaggtcgaggctgcagtgagccatgatcatgccactgcactccagcctgagtgatgagagtgagaccttgtctcaaaaaaaaaaaaaaaaagcataatgacactcattttaactagttctttgattttcaacgtaactttctaattacattttaatccatgttctacaattcctgtgcaatttctccattctctccaacacctcccctcactttattttcatttcagacacattttcaaatttaaaatttgcagctgggcgctgtggctcgcgcctgcaatcccaccactttaggaggctgagatgggtcaatctcttgaggtcaggagttcaagaccagcctggccaacatggtgaaaccctgtctgtactaaaactacaaaaaattagctggacgtggtagtgcatatctgtaatcccagctactcgggagggtgaggcaggagaactgcttgaacctgggagacagaggttgcagtgagccaagactgagccactgcactctagcctgagcaatagagggagactctgtctcaaaaaaataaaataaaataaaatttggagttcattaagctctgcgggtttaaataataaaattctcacattacatgcttgtactatgactgctcggaaacttacatgtcgcctgaacttatggatgtaagttcatagacatgggacttctaaagtcagactggagcctaaggacaccaggccggcaggctgctccctggaccaccaacttctgtcctgctgcctaacatcaagtggatgtttgttcagtgtctttcctttctactttctcttcccatagcagattattcttgatgttcaagtgttttaaaaggaaggaaagattgaaaggtaaaaaaatgacactaattgggaagctgctagaattaaccaatgtgaaattaaaggtacagctttaactttctggtccataaaataataccacaaatagatggtgggcatcacacaatgtacagaattattaagaatctttaaaacctaatcttaacccttattttaggatggaaaagagacacagaaaacagatacagagattaaatacacatactccctcttgatttctagagcagtttattccacctgtatataaagtcaatttcagatcaagatatttctctataaggcatttaacaaaagaaactttctctaccaggtatttaataactagtttctaagtcttttttttcttgcaatatatatctttttttccaccatttccacttatccgtatacaaaacatgttatgtgtaaggcagtagcatgaggtatcccccaagaaaatttgaaacgagtgaaatgagactgccatctgcattagatccataaaaaaccaaagagaggcaaagtcaccttaacaactagctcccaggacagttgcctaatatctgcttgagaatattaacgtatctaaagaaagagaaatttgtctatcacaagggcaatggtagcagaaaaaaagcaagaggggtaaacactgtcaatactcttacaagcacagcccaggaaaggagtccaaagtgtgcaccgtgaacatcacaggtcactggaaagaatttctctataggaggagaagaccctcaggcccccatcccacccttaatattctctgctgaaattccaaccccataaagagatgaacaacatttggattataatctgactccccatttaaatttgcctgccaaggagaagacgtactaatcatttcaatatgagtacatgagtattccacctcatatggtatacagatacatacatgttcacatggcgtgtgtgtgtgtgtgtgtgatctccactcctcagctggtgaacaaactgaatgcatccatgaaaaggtgatctttctcaatggtatgttaacaaaattaggttcctaaggcttcatatgccagaggaagaccatggactatggttaattcttttaagataatgaatatccctttaccagtgaattttgtgctctctcttaggatgacagcttctacttcatctgtaatacctatggcacctaatagagtatcacatacatcatagaaattcaaacgcttgttaaattgttgtattctaaaataaaaaaaggttgttatactttggcaaatgaaggcaattagaagtcccatgcctacgccaaatgtacagcttgaacatcaaaatctaacaatttttaaaagcatcttttttttgttttttgagacggagtctcgctctgtcgcccaggctggagtgcagcggcgcaatctcggctcactgcaacctccacctcccgggttcacgccattctcctgcctcagcctcccacgtagctgggactacaggcgcccgcgaccacgcccggctgatttcttgtatttttttttttttttaagtagagacggggtttcaccatgttagccaggatggtctcgatctcctgaccccatgatctgcctgcctcggcctcccaaagtgctgggattacaggcgtgagccaccacacccggccacatcttttttatttttaccaaatcagtacacaattgtctaatgttgtttcatggaaatctgcagcaagttattccatatatagtaagtaaacatttacttgctggctgctagcagatttattaccttagcatatccgtacttcaggaatgcaatttgacagtcatactagtaaaacagtaagtaagacactcaacattcatccatgccatccataaatatatgttaaaaaccacaaaaaacaatgtatcaagtattatctattgcaaaatgaaagtacattaatggtaaaccctgcccttcccctccaaaaaaatttcagtcaactatactattctaccttctattctgccttctaccctcccccataaggaagcagcaaactaccagtttctcatccatatttcttcacacacactctctctctctctcacacacacacacacacacacacacaaattccagcatatctaattatcactgtcctttgtacacaaatatgtcatgtcagcgactggttgctgtttacagacaaaagggaagcttcaaagaccaatgcacagatataaataaattcttgaagcgaaaatatttcttatttatttttttagagacaggatctcactatcttgcccaggctggacttgtacttctagactcaaaatgattctcctgcctcagcctcccaaatagttgggactacaggcatgcaccactgcacccagcccttcgtgtaaatatatttcttacaagggacatttactgggtgaaaaatatggctccagacctggtagaatttctgggtttaaaaaaatttttgttttttagtatcctttagcgttaatgcacattaaggcaaattaatgttttagtctatcaaaagccaattcagccaagtatgttttcttttaaatcaccattttgaatcagagaaagatctgaactatcacattgtacttccagaagcctacctgttagcattcgtgttgatagaatgaacttctccaatcctagatggtgaaatgtgtattacagggagattagataccacagggcagagaattgagtggcctttctttgagcaaatgtattgtttcagttacttacattctttatgacctccaaccacataagatgccaaataatagcatatatgattttgtcagtccatacatataaaacatacatctaaacacatgtcaaaatacatcataaaaaatagaaaagtaacattaatgttttattcagtatgaataaaatgtgtcaattgggataaatgtatatgtaaccaaaatttacgtctggtaaacataaaatttttactgtaacaatttttagaagtgatttcaggccaggcacagtggctcacgcatgtaatcccagcactttgggaggttgaggtgggcagatcaccagaggtcaggagttcgagatcagcctgtccagcgtggtgaaaccccgtctaaacatacaaaacaaaattagccgggcgggttggcaggcacctgtaatcccagctactcgggaggctaaggcaggagaatcacttgaaatcggccggcggaggttgcagtgagccgacattgtgccactgcacaccagcctgggcaacagagtgagactctgtctcaaataaaaaaaaaaaaaaaaaaaaaaaaagaagtgattttaaatcctctacagaattttcacagaattgtttcccctagggaaaaaaaaaattatccttaaaatacatcatatcattttaaattggataattactctttatgtacgtaaacacttatgatgaaaaaatgcacactcgctttgtataaatttgaacagttacatatctaattaatagttgatgctgactaaataatgaaacttttgtctaaaataactggcaaaaggccagaaacagacaatgcagtgaagaatggtccatcagaatactagaaaagcaattacttagatgaaaataaatatcagcctttattagcatgaataaagagaaaattagaactgtaagggaatgaatatttcttttaattcaacaatgaagcaatatagctgcctctaaattaagttacctttcatttgctctcaagtttctctaattcaacgatgaggtattttaattacaaaatttgccaggtaaactgtaaagcaagctcatgtttccaaatatgctataccagatttgaacatggttatttatataaaacttcactggaccagttattttgggtttggagatcatacaataatttttagttttatctctgttggtgtttttctagtcatgacgggatgtctaggaagacaaattttctcaataatggttttcttccccctttccttttgaggtatttataaaaccaaaaacaattatttctgggtacttaattccacccttcagggcatgaagtgtgtctcttatcatacggaacacctagaatgcttttaaactcaatgataattaagaaacatcaaagtaaaaccagggtgtttcacagggaaccaggagctatcattttttggctaccaaatgacatatttcttgtcccctggagtactaccaagacttttttacctaaacaatagaatgtacttttttaatgtagcctttactcttctgaggatcagacatatctgagctttaaaagtaaactgctaaaggcaacaaaagcaagaatagacaaatggaactgaatcaaacttagaaacttctggccaggcgcggtggctcacgcctgtaatcccagcactttgggaggccgaggcgggtggatcacgaggtcaggaggatcaagaccatcctggctaacatggtaaaaccccgtctctatgaaaaatacaaaaaaattagccaggcatggtggcgggtgcctgtagtcccagctactcgggaggctgaggcaggagaatggcgtgaacccgggaggcggagtttgcagtgagccaagattgcaccactgcactccagcctgggcgaaagagggagactccatctcaaaaaaaaaagaaaaaaagaaaaaagaaacttctgtgctgcaaaagcaaaggaaacaatcagcagagtgaagagataaactatagaaagtgagaaaaaatgtgtaaatcatatttctgataaggggtatagacatatagacaactcttaaaactcaacaacaacaaaaaaagcctgatttaaaaataggtgaaggacttgaatagatatgtccacaaagaggacatatacaaatgcccaaaaagcacgtgaaaatatgcttaacatcaggaatcaaggaaaggcaaatcaaaaccacactgagatatcacctcaaccatttttgaatggttaccatcaaaaaaaaaaaacaggaaataataagctgtgaggttgtagagaaattggaacccttgtgcactgttggcaggaatgtaaacgatgctgcccttatagaaaacagtatggaggttcctcaaaaaattaagaactactgtatgatccagctatcccacttctacatatatgtccaaagattgaaagcagtatcttttacagctatttgcatacttatattcacaacagcataattcacaagagccaagaggtggaaagcaaactaaatgtctatctacagatgaatggataaagaaaatgtggtatatacatatgatgaaatattatttagccttaaaaatgaagacaattctgttgtatgctacaacataaatgaaccttaagaacattaagtttctagctaagtgaaataagccggaacaaaaagacaaatatgtactgcatgattccacttctatgaggcatctaaagtaggcaaactcttagaaatagaagctagaatagtggtttcccagggctgggaggaaaaggtaaacgggagttgttattcaaaggttaaaaaatttcagctttgcagaatgaaaatgttctagagatctgctgtacgttaagttacagaaaacactactgaactgtacacttaaaaatggttaacatgggccaggcacggcggctcacgcctgttatcccagcactttgggaggccaaggcgggcagaatgctgaggtcaagagttggagaacagtctggccaacatggtgaaaccccatctctactaaaaatacaaaaaaattagccagtcatggtgccatgtgcctgtaatcccagctacttgggagactcaggcaggggaattgcttgaaccagggaggtggaggctgcagtgagccgagatcacaccactgcactccagcatggacgacagagtgagactccatctcaaaaaaaaaaaaggattaacaagatacattttacgttgttttctaccacaatccaaattgctttttaaaaagtcaacttctaaggaactaagaatggctaaaacaatcttgaaaaagaagaacagaacgaagttgtaggactcacacttctcaattgcaaaacttaatacaaagctacagtagtcaagacagtgtggtactggcacaaggacagacagaaagatcaatggaatagaacagaaattccagaaataaacccttatatatcatggtcaattaatttttgacaagggtacccagacacctcaatggagaaaaactgtcttttcaacaaatagtgctgggaacaacagacatccacattcaaaagaataaagttgtacccctacctcatactatttacagaagttaatccaaatggattaaagatctatgaatccaccctgtgggagctcaaactgtaagacacttatcaaaaaaaacacagaggtaaatcttcatgatcttgggttagacaatagtttcttagatagcataccaaggacagaaacatcaacaacaacaaaaattgataaattagacttcatcaaaaatttctgtgcttgaaaaggcaccatcaaaaagtcaaaagacagccggggctgggcgtggtggctcatgccagtaatcccagcactttgggaggccaagaccagcagatcacctgaggccaggagtttaaagagaccagcctggccaacatagagaaaccctatctccactaaaaatacaaaaattagccgggcatgttggcacatgcctgtaatgccagctactcgggacgctgaggcaggacaatggcttaaacccaagaggtggaggttgcagtgagctgagatcacgccactgcctgagcgccagagcaagactctgtctcaaaaaaaaaaaaagacagctgcgcacagtcacagtggcttatgcctgtaatcccagaattttggggggtcaaggaaacaggatcgcttgaggccaggagtttgaaaccaggctgggcaacatggtaataccctatctctacaaaatatatatatatatatatataaattaaccaggcatcgtggcttgcacttgtagtcccaattactacggaggctgaagcaggaggatttcttgagcccaggagttcaaggctgcagtgagccataatcataccactgcactccaacctgcacaacagaactagaaagaccctgtctctttaaaaataaataaataaataaagacaacccacagaataggataaagtatttgcaaaccttgtacctagcagagggcttgtactcagaatatataaacagcacttaaaactgcataataaaaagacaaataacccaagtgaaaaatggccaatggagacatgtctctgttttccagaaaagatacacaaatggccaataaagtgcataagatgctcaacatcactagccatcaggcaaatgcaaatcaaaaccacagagatatcacttcatagtcactagtatgattcaaataaaaagatactacttcacacccactaagatctgtaaaaataaaaagacaataacaagggccaggcgcggtggctcacgcctgaaatcccaacactttgggaggccgaggcgggaggatgacgaggtcaggagatcgagaccatcctggctaacacagtgaaacaacgtctctactaaaaatacaaaaaattagccagtcatggtggcgggcgcctgtagtcccagctactcagaaggctgaggcaggagaatggcgtgaacctgggaggtggagcttgcagtgagccgagattgcaccactggactccagcctgggcgacagagcgagactccatctcaaaagacaaaaaaaaaaaagacacataacaagtgttgaggagggtgtagagagactggaagaattatacactattggttgaaaagtaaaatgctgcagttgcgttggaaaacaatttggaagttcctcaaaaagttataagtagataggccatactatccaacaattctactcttgagcatatacccaagagaaatgaaaacattatgtccacaaaaacttgtacatgaatgttcagggccacattactcaaaaagtgtaaacaacccaaatgtgctttcattgaatggatatataagaggtagtacatccataaaatggaatattaatgtacattttaagtgggtgagttatatctcaataaagctaataacagcaaactgctatgattatatagtgttatataaaatatgaaatgtaccatttggaaaggcacttagaaattaccaaactcacttgacttacaaatgagagaacacaggctatcaaaagtaggtggaatagaacagggcctctatagataccccgtcccagcgctgttctgagtctctaacaggcaacagtacaactgccttccaagaaacagccagtcacctgcgtagagatactgactggataaagaacaagtgcaggatacctgcagagagtagctactgccatgtattcctctctctttaattaccacacagcactaacctattttgttctaatttgggggttttcattgccaggggaagagttaaaattatggccttcatcttcacaagtccctcttttctcttctactactcccaacacaaaccataataaatggaaatgaaactgttagaaaaaggaatgttaagacactcatgctttttctgtgggaaggtcaccagccttagatgaccacggcagattcatctatatatagctatatatagatagatttttttttttttttttgagacaaagtcttgctctgtcgctcaggctagagtgcagtggcgagatcttggctcactgcaacctccgcctcccaggttcaagtgattctcctgcctcagcctcccgagtagctgggattataggtgcccgccaccacgcccagctaatttttgtatttttagtaaagacggggtttcaccatattggccaggctggtcttgaactcctgaccttgtgatccacccacctgagcctcccaaagtgctgggattacaggcatgagccaccacgccctgccccatctcaatatattctacacagtacttccgcccgctggccaaaaggctggggcatagccctaggataggatagctgggcatttagcatcccacctgggggaaagactatgaaaaataactctctctccctaaaacaaggataacttagcccatactttcacaagacactaagaaaagcttaatagaggtggctgggcacagtggctcactgtgggatcacactgtaatcccagcactttgggaggccgaggccagtggatcacctgaggtcaggagttcgggaccagcctggacaacatggtgaaaccttgtccctactaaaaatacaaaaattagccaagcgcagtggcgcacgcttgtagtcccagctaatcgggaggctgaggcaggagaatctcttgaacccaggagatggaggttgcagtgagccaaaatcacgccactgcactctagtttgggcgacagagcgagattccgtttcaaaaaaaaccttaacagagaaagtacaactgttaaaaagccttgcctaaaagaggtaaggtcaagaaaaattaaaaataactttacagggatttggcaataagtcattaacatatttgaaaagttattggagaaccccaaaagagtttggaaaactgacaaaatctgttgaaatcaggagacaaaaatattttatttaccctcagtaaaaacggttctcctagtttaaaaaagaaaaaaagacaaacttttgggtaaagagggacaaatgtattataatgtaccattttctattcaagtgttttcagaattcttaaaaaggtaattctcttcatctctaagattttaaaataatattttccaatacaaaatttacaaatacttattttatttatgatttgaaaatgaccacattatcatcctttttctcctctgcatctagccaattaagcaaatgtatttctaaagaaccaggctatgctagaggaaaatcaaaggaggaaaagagcaaaggaaaattaataggctacattatttttacatagattttaaaacatatatatgacatctatgaaatatcttttaattattctctagatatggaaaaagataaactgctaatagatccattcatatatatgatttagtcagtactaaaaatagttatgttagtcaccagaaatactgcttttgtcctctgaaagatttgaaaaaagaaaataagactttccattgctgtcaaatgtattcaattttcccctcaaatgaagtttggatgaaaacaatgtgactgacaagccccgcacaggcaaatcttggcaaccctcaactctgtctatctccttggcctgttaagcaaaattccttcacaaactgttggtctttgcaataactcctacaaagctcattactgccagcgtcggcctatcccccatgttgtgcatttatccctgggatgcatatcaacatgtggcacatgtccttgacatgcacagaagagctgcaccccaggacagcagcatgcacgacaatagtctcgacgcttacttctttacggttgctgggatgtaaccgagaaatctaataactgtgacagtggggcctttcggtttttccttgcctttccagacagtgaagctgcacagacactaatgaaaggttaaatgaataggaatagttgacaagaggtacaataaagaaggagcttggtaatccacagacactgagcagagatccttggctcaagcagagaaaggacagcacatcgtcgagtcacaatatttaaaacagcttgctatacacagaggcttttgtgtctgggtacacgtctggctttggactgaaaaaaaaaaaaaaaaagacactgaaaaggaatttcagcatggggcactttggcaaatgtaaggtcattataagagaaaaatgttttgtgtaggttgttacatctttgtaataaacacaaaaaagcagggactatgaactcatgaaccacaagttccaagacaatactgtacattttgacaactattaaatactgtatctagaaggctggcttgatgctattcccactggtaagatacatacacagtgagtcatttaggagtttcacattctgccttccttatggaagaattcctgatactcatcttattagagttttatagtcaagttctagtctttagtgaacgtaatttgttacaaatacaaccaaaactctcaaagccaccttctactcattgaaaaacttcacagcagttactagcaatttgtgaagtaccaggcaaactttttgtaattgtaagtgattgcaactgtgaaatggcctcagctagaattcttaattatcgaacctattattttttggtgcccttctcactatacctcaagggaaggttgtattccttaggaagtttattttaaattataacagcaaaacaatttaaatcaccaagagaaaaatactctagaatgtcaaagagaaaatagagcaaaaagaacaaaactgatattgttatgtacggatatttttaaaggaaaaaagttatgacgatagcaaaaacttaaagaatgatatatctgtaatatcattcttacgcatattgagttagaatataggttcttacgcattgagttagaatatgggttcgtaacaaatggtaaaagcatactgagaatatatttcaaaacaagggaggctctttgaacagccaaattaaattatagctgaactcttgagtgtactgagggttctaataagcaacaaataaagacttttattggctagcaacataatgagagctactgtgcaaaagattttaagaaggacaaatctgggtagtttatctcactggattatattatttacttaaatgataaatatgtttgtctaaagtaatgctcctaaaaactagtatataaatattaaagtgcaattatgatcaatgactctttaacataactgtatcacaaatgttaatggaaagtggtaaatatgaaattaaatgacaattattgaatgtaatatcatttaaatcctatttctttaacttattttttgatccataataagtcaggtttataaatagtttaacatttatgcttataacaggaagcatttattttaaagaaaatttctctctggaatacagaagttgtatgtagaactactccaaaaccatcatttacagaaaaggggttgtccttcataaactaaaagaagttaacccacttctcggtgatttcgtaggaagctacttttaatagaactctgaagactggcctcctaaaacgagagtaactccctcagttgacaaaaactacaaacagtagttagtcaaaccaaaacatttaaaatatagtatctggttgcattttgcctgatcttcaaatcacctgaaaggcaaaagcctagaaagcttagctgacgccttgactgttcttgtagaaagttcttttgcttctgtcacttttaaaaaaaaaaaaaaaaaaaaaaccataatagcacctcccagcctcaacactgagccagtattcattacctactctttttgtgcaacattctgatggccagagtgttttttaaaccttaagtatatctaataaaatcatgaggctccctctagctcttcagaggggattttactaaccaatgatactatataattcccatccaacaggaaagatttgaggaggctacctccccttccacaagaaatgttttccactctgtttcttgtaaggatgtagatggtaaatgagaccatctgctgagtaaatcagaaagcgttgctccttatatatttatcaagttaagaatctataaactgcttccaacctaagctttatgtacagaattctatagtgaaactttaatcagattaaaccatacgacataaatttacccatcctgtctaaaattaattttaatgtcaaaaaacaacaacatgtatgaacatccacagaaattcaaacttgtggtctggtctcagttttaaaaatctacatttaaatgcagaatctcaaaaattcaggaaaaaaacacttcatgaactgtatctgtggggtttatataaaacaaagatgctaatagtatagaaaacattttcatgtaccatagtatttatacacaatactagtataatgacttttttattgtttaatcttacctgcaatttagtattggatatttggggatcgtaggttgtttagaagactataaataatacagttgaagtatgccatcttacaataaccataaaagccacattgtcaactggcaaatcatctcaaacaagtgaatgtgaacagtactaaattgaactcctcatattcactaaggccatctttcaaatacttaaggaatatttaaaaccgtgctgaacccttaactgtaaaattaaaagtaaaggaaaccactaacttcaagtcatcatctattttggactcccttaatataagaaatattcccaggaacaacaacaaaaagaatagctccctctacccccccacccccacccctttttgagccagtgtccaatttcttcttttctgaacagctgtattatccaacttaagttgctctgctaatttcagtcccacaaggactaacttggaaggcaaaaaaatacaagaaaagatcaatttgctgggaaagatcaaatgagaaaactgtggggacagcaccaggtcagcgtgtggagaactaagcagacctgttcttcattaactgcggctctctggggatgtcacacactacctgtccgtgggctttattgaaccgcctaacccgcctctctgttccattcttctgggcccaagtgaatcatatcctgctgctgacaagttagcaggggactgcggctgcaacatgaaagtacttttctttcttgtctaaatcaggcagatttttgaaaagacgacacagcattgactcgtgacatggcaagatgaaacgagaggtctgggccggtcttggagctgtgcagataaaagtaatcaaatgacactcctggaatgcaaattggcattcttgactgcagcaattgcacaaccatgaaacatccctgacagcaagcaagattaggacaaaatgttatgtaaagcactgaactcaagaactctcacttgaaaattcaaactgtaacacttacattttaatatagcaatagtcagctctgcttttgtctgcttctttttgtaatcacatatctctatctgacagatatcttacatctcaaatagaagaaaaaatcaggtagtaggaatgtactgctattaacattttcctaatattaattgtaaaatataatgcacagtttattcttattcaaagtcttacatgcaaacaccacccaacttaatattctcaagaggaaaaaaagtttcagacctttctcaaaagatactcaaaacaaagttcaggttcaagctcgttattacttccctcaggtaaagatactcctgtactttggtaaagtgattagcaatctggacttttaatacagcgcactctgggaactaagaacttcattaagactgaacagtttacatgaaacggctacaaatataaaacacagatactctctaaaggctcacaagggattgtgtgtgtgtgtgtgtttgtccaaaaagtaaatgttctgttaacttgtacaaggtctcactactagggtacatcttcagatcagacacactaagtaacgtgccagaaataaattcctcccatttaaagcatgtatgcgtgtggacagtaacacgtgaaattgcagaatacaaagcagtggaaggcagacaggcttagccacagttcaaagtcattaggatataggaatacatgtgtagacaaatagttaacataggctagggtaaagggaagaaaaataatacctgccaccggcttttacagtgttcttgtgtaaaacgcccgttagaagaaaaactctcaagctctaaacagatatatttaatattgttgtgatgtctcacttaaacacggctttcaacaattccaagtgtccacgaagtatataaaaataaaacaggccactttttgccactttaatcctgggtacacaggattattttatgatgtcttttgtacgtcagttttacaacagcttgactctagggtaaatgggaaccatcataaatcgcacgctgctttcaaaaccactttaatttctgtcagcgttactgtaaccacagtcctgggctcttgcttttgtgtgtgtgtgtgtgtgtacgcgcccctgcatttgacagtcccatctcctacactccagttgtgactttgatcactgaaacaagagatgtcacattagggagcagggaagaggaaaaaatgccaacccgctatctcacctgtattctcatatgttccctctatatacggaatacaccatgtcagatccccaagtgggggtaacaatagcgacgctgggaggaagcaaactaaaaagaagggagtggtcaagccccatttctaacaaatcacttccccgaaagcggacagagcggctcatcaccaggcgaactaattgcacgcttcctcgctgcaaagaagtcgcttctcgtagaggggctgtgctggagtctcgcttggcaaagccagcccatctcctccaccacttgcacttggaactttttttcaaccttaaactcacttcacaggagatttcacctagggtttttcagcatatataattttttattctgctccctccccaggccccaaatcccaccctccagtcaacgtgcaagtaaaacaaatcggctcctatagaattgcacttcgaaaagagccgtctctgcaaggttgattttcctgccctgcgttctgcaccttctccgtaaagcctgcgggagcatttcctcccatctccatttaccacgggaagattccgaatgtgaagacaaggggagaggaagagtcaacgtgccgggcccgggcggctgcgccccagcgcacccggcacccacgcccagccgccggtccctcactcggcggcaagttgtaaaagttcccgtaggtcccagccgccttcctctcttccccgagctcctgccagcgctccattcatcccccactcccctccacctcgtccccccagcccgtccccaacgccctggagcctcccctagccagccgctcaccttcgcgcggaagccgcgagcggggccgaccttgagaagccccctctcacgtgcaccctcccacctagagctcgcctcagaaacttggggccaagtttaggggaggccactgggagcgcagcggggatcaggtcggaccggggttctggtccccggcccgccctcctcagcgccccttgcccctcacgccgcgggccggagggcggacacggcccccgggcggccccggtggcgctcgggcgcgggggtcatttctgaggaagtctagaataaaagaggaaggagggtggaaacttcttaccatctcggcatgctggttgtcaagtgcagcccccgcctcttggtctcctcttagcggccgcgcctggaccagcccctcggccgccgctggctccctccgtctcggcctttctctccctccccctccgagttcctccgggcctc

SEQ ID NO: 145 - DNA, 49571 bp, Homo sapiens
acatctctcggcttagtaagggctgcttactgtgggaatatgactcccatctggaagaccaggtggagacttgttcccatcaaagtaagaaacctattgtccacgtcaagggcgaagctgatgtgctgttcctcaaatgagtaaaacacacttctgtagtgctggaatgagtcaggtagttcaaagtacattgacggagtcgaataacatctatccagtgagtcctgcaagacttcaggctcttccacttccatcagcatgccgctgagcctggaaaagcagacaaaactaaagaagcagccagggaaaatcagacaccacagagccccactagatttcagaagtaacgtaaggaagtggtaagaaaagaaaaggatagatccattagatccattaatgaggtaaaaaaaaaaaattattgcctttatgttgggatagaaaagggccaggtagaaaacaatgaaagagaaagacagagagacagagacagagacagagacagagagaaagtgagctagtgaattggccaggtgacatactggtaagggagtaaaaggacactctgagttagtgccctcatgacacacagcacactgcgatcatgaaaagagtgagctcaatagttttccataaaatatgctcaaaattcgatgcagtggccatgagagtacagcttttgaagtatggtcatcctatggtacgttagtaaatgataaggggaggaagaaatggaaacctaaacatctactgcaatgaaaaccaacagcaatgacagtaggagtaattcagccttcgttgaaaacatgaaatcaaacacactctggtttccctcaatctgttgcctccaggtgttaacacagaattaagcatccacaattgctgaaagttacctggggcatggtgggttttgatcttcttccccttcttttcttccccttctccttcttttcttcgttgatcttcttccccttcttttcttccccttccccttcttttcaatttctgcaataaattcagacatggacagacacattaagctgattcccctacacacataacaatccactgtctaaccctcacacagggacctcaggctcctcagcataagaataggagactgtgagagatatatttcaggaggcctgaaggctggtcatgatagaaattcctcggtttttctcccagaaactgtgggtaaaatgtccctattctagtagatcgttatcccaatatcatttgtcccgagtttgtgcaaacagttatgccatatttttccaatcaatttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagagtagaatcagagtgccacaggcatggcctgagactaggaagagagccatgctcactgacccatcccatgtctgggcttccagttagaactagagtttcattcaacctacatgtgcctataggtcctcactgcagcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggcaggcaggagtcaggctgttcaagacaactggaaggagttgaataacatctatccagtgagtcctgcaagacttcaggctctactgcctccagcagctccctgctgagcctggaaaagtaggaaaaagtaaagaataagccagggggaatcagaaaccacacagccccagctacatttcatggctaacataaggaactgtttaaacagaaaaaggacagatccattaatgaggtaatgaattattgcctttatgttgggatagaccagggccaggtagaaaagaatgaaagagaaagacagggagagggagagggagagagagacagaggagaaagtgagctcagcgaattggccgggtgacacactgacgaaggggtcaaaggacactctgagttagtgccctcgggacacacagagaacagtgatcatgaaaagagtgggctcaataattttccataaacttgcttaagattccatgcagttgccatacagcctttgaggtatggtcaacctacagtaagttagtaaatgataaggggaggaagaaatggaaacctaaacatctactgcaaggaaaaccaacagcaatgtcagtaggagtaattcaaccttcgttgaaaacatgaaattgaacatactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacgcagggacttcaggctcctcagcatgagaataggacactgtgagagatcttcttcaggaggcctgaaggctgatcatgatagagattcctgggtttttgtcccagaaactgtgggtaaaattccctattctggtagatcgttatcccaagatcatttgtcccaagtttgtgcaaatggttatgccatatttttccaatcgatttaaagcaaatgcccccaaatggttgctgggagaaaaactgcaatattcagccctgtctcatcaaatactcagattcttcatggtagcgaggattttagatgctgaaattagagtgaaggatgaaatctacaagatctacaaaattgagacaaaatcagagttgtgtgaatttgtcacatctgcccagatccaacatcttgagagtgggattagggtgccacaggcatggcctgagactaggaagagagccctgctcactgacccatcccttgcctgggcttccaagtggaactagagtttcattcaacctacatgtgcctataggtcctccctgtggcaatgacatctctcagctcagtaagggccatttgcagtaggaatatgaccctaaccagaagactcagtggatccttatcaccttcatagaaaggtactcaccatccatgtcaagagcccagccaacacgctgttgctccaatatgtaaaaggcacttctgtagggctggcatgagtcagtcagttcaagataacctgaaggagttgaataacatctatccagtgagtcctgcaagacttcaggccctttctcatccagcagctccctgctgagcctggaacagtgggaaaaagtaaagaataagccagggggaatcagaaaccacacagccccagctagatttcatggctaacataaggaagagtttgaaaagaaaaaggacagatccattaatgaggtaacaaattattgcctttatattgggatagactagggccaggtagaaaaggatgaaagagaaagacacacacacacacacacacacacacacacacacacacacacacacagagtgagctcagtgaattggccaggtgacacactgatgagggagtcaacggtcattctctatttgtgctctcaggacacacagtgaacagtgatcatgaaaagcatggcctcaataattttgcataaaatgtgctcaagtttccctgcagccaccatgagaatacagcttttgaggtatggtcaaccttcactaggttagtaaatgataagggtaggaagaaatggaaacctaaacatttactctaatgagaaccaaaaagcaatgtagtaggcataatttagacttgtctgacaagacaaaatcattattttcagcatgtactgttttccctggacttggcatctccaggtgtcaacatcaaattaactgtccacaatttctcagactcacctgggacctgttgcctcttggtcctcctttttcacttgatcccaccgatgtcctgcaaataaattcagatggggcctcttacattaagcagttcttccttgcacacagaaacattcctctgtccaatcctaacacaggtacatcagtctggtcagtgtgagaacaggagactttgagagaaatattccagcaggcctgaggtcaagtcttgagaaaactggcttgggttctttcatgagccttgggcaaaattaccctgttttggaatgttatcttccctatgtgctctgtcctaggtttgtgtacacaaatgagcaactttttccccaataaattgtaggcaaatagttctaacacctcataggagagatacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtcagccatttatctagaaaacataccaggaacatgacggacagatgagctaaagcaagcgaacttagaagacacagaaaatgggaataaattcagtgaaacctgggccacatctttcactgagaggtagacaagggtgacacttgccttgggcaggtaaagaaccacacagacatgctttgggaacaaaactcataaggaattttgtagctggcaagagacatttaattcagatgagctgatctgacagacaactcctggtcatgtgctgcatagtttggtgtgagcttgccacacctgccttgagttcaatgtcgtgacagtcagtccaggttggcacgggcatggcctgagactaggaagagagcaaagctcactcacccaccccatgcctgtgcttcagactcgactccagagtgattgaaatctacattgatatataggttcagcccacagtgatggcaaatctcagcccaacaaggggcacaaggcccaaagattatggggtctacctgggccatgaactggagctttatcaccttcacaatggagtactcaccgcctatgtcaacagccatgcagacttgctgttcctctaatgagtgaaatgtgccgctgtaagacttgtacgaggccaacatttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactagccttctaaatacagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacacagtgcagacacagatcttgtgtattaagggccccattttcccaatattttgatataatatatttaccttttcaatttcttttcttgcaaaaatactagccaacatactaccaacagataggaagaaagcatatatacatctctccctggatttaaacacatgggagagaataggcaacaccaagaaatccctgtttgagggtctggagtggacttccagcaaactccaacagacctgaagctgagggacctgattgttagaaggaaaactaacacacagaaaggaatagcatcaacatcaacaaaaaagacatccatcccaaaaccccatctgtaggtcgccatcatcaaagaccaagggtagataaaaccacaaaggtggggagaaaccagagcacaaaagctgaaaattccaaaaacctgacatcccttctcctccaaaggatcacagctcctcgccagcaatggaacaaagcaggatggagaatgactttgatgagctgacagaagtaggcttcagaaagtcggtaataacaaacttctctgagctaaaggaggatgtgcgaactcatcgcaaggaagctaaaaaccttgaaaaaagattagacgaatggccaaccagaatgaacagtgtagagaagaccttaaatgacctgatggagctgaaaaccatggcacgagaactacgtgatgcatgcacaagcttcagtagtcaattcgatcaagtgcaagaaacggtatcagtgattcaagatcaaattagtgaaatgaagcgagaagagaagtttagagaaaaaagagtaaaaagaaatgaacaagcctccaataaatatgggactatgtggaaagaccaaatctacgtttgattggtgcactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacataattgtcagattcaccaaggttgaaatgaaggaaaaaatgctaagtgcagccagagagaaaggtcggattacccacaaagggaagcccatcagactagcagcagatctcttggcacaaaccctacaagccagaagagagtgggagcaatattcaacattcttttttttttccatatgtatagttttcctttattattttttgtgtgtatgtatatatatgtatatatatttttcaatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttccccttcctgtgtccatgtgttctcattgttcaattcccacctgtgagtaagaacatgcggtatttcgttttttgtccttgcgatagtttgctgagaatgatggtttccagcttcatccatgcccctacaaaggacatgaactcatcattttttatagctgcatagtattccatgttgtatatgtgccacattttcttaatccagtctatcattgctggatatttggcttggttccaagtctttgctattgtgaatagtgccacaataaacatatgtgtgcatgtgtctttacaacagcatgatttataatcctttgggtatacacccagtaatgggatggctgggtcaaatggtatttctagttctagatccctgaggaattgccacactgtcttccacaatcgttgaactagtttacactcccaccaacagtgtaaaagtgttcctatttctccacatcctctccagcatcttcaacattcttaaagaaaagaattttcaacccagaatttcatatccagccaaacaaagcttcataagtgaaggagaaataaatcctttacagagaagcaaatgctgagagattttgtcaccaccaggcctgccttacaagagctcctaaaggaagcactaaacatggaaaggaacaaccggtaccagccactgcaaaaacatgccaaactgtaaagaccattgacgctaggaagaaactgcatcaactaacgggcgaaataaccagctaacatcataacgacaggctcaaattcacacataacaatattaaccttaaatgtaaatgggctaaatgccccagttaaaaaacacagaatggcaaattggacaaagagtcaagacccatcagtgtgctgtactcaggaaacccatctcacatgcagagacacacataggctcaaaataaagggatggaggaagatctaccaagcaaatggaaagcaaaaaaatgcaggggttgcaatcctagtctctgataaaacagactttaaaccaacaaagatcaaaagagacaaagaaggccactacataatggtaaagggatcaattcaacaagaagagttaactatcctaaatatatatgcaccctatacgggagcacccagattcataaagcaagtcctgagagacctacaaagagatttagactccacacaatcataatgggagactttaacaccccactgtcaatattagacagatcaatgagacagaagctttacaaggatatccaggacttgaactcagctctccaccaagcagacctaaaagacatctacagaactctccaccccaaatcaacagaatatacattcttctcagcaccacatcacacttattccaaaattgaccacatagttggaggtaaagcactcgtcagcaaatgtaaaagaatggaaaccacaacaaactgtcagaccacagtgcaatcaaattagaactcaggattaagaaactcactcaaaaccgcacaactacatggaaactgaacaacctgctcctgaatgactactgggaaaataacaaaatgaaggcagaaataaagatgttctttgaaaccaatgagaacaaagacacaacataccagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagacacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaccaaatcactgtccagtcatagcacaaggacataactattctcagtgcaagaataaggattctgacaggaatattctagggtgccctagattaactttggtgagaattagatgaccctgctttccagacccacaggccaaaatctccctctacgtgtagaccataatgccatattccctgcctgagtcaaagttaaacaaaattttttccccaaaaaaatctccaaaaattggtccattttctaagagtgttgctgcaatacggacttatatcaccagataacatggacattaaatgtttagaggcatctatacatgaaacacacatgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgcaactgcactctagcctgggtgacagagcaagactccatcgcaaaaaaaaaaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttccgtcctgatttcagggtgactgtgcagctaagcaagctgacttaaaggagatccggatgaaagctgagagcagtgaagcctggggaacaatatttccaaatacaaaggcaaggctgccagcttcctgaaacaggcatagaaactccatggacattgttcagggacagatgacttaatcacagatgacaagagatactgaatcgaagctaggaggcctgacagatactgcctgtgcacctcctgcactcaggtgactatgagattgtcacacttgcctggggtcgagtaacttgatactggggactggcagacaaaggcatgacattagctgagaaggacaaaaaaactccctgatatctgtttagaaacccatcatagttttttattcaaatgaatttgtgtttatagagcctgtcttcagagtttatcttcctcagcctagagagaggtatgagacacaaggaaaacagaggctacctgggataatgtgtacagcatcctcccattcaacatgagaggatgagccaatgagagttgagtcgactttgtcttcctcaaatgtgattttggttttcctatgtggctggttggagtcataagggccatggctatttgaacaagtgatggcacattcctccagtgagtcctcagggacttccttttcttcagccttcggcatctccctgatgagccaggtgggacagagatgacagaagattaaacacagagggattggaccccagggagtcctagctggttttgacaggcggcattaagagagtggtcccagaaagcaaaatggaggttccctttaagggggaacatgcaatcctgttctctctgcaacagagcatggctgccatgggaaccagagaggaagagagcagctggtgttcattgcagtggacagataggagctgaggaggatgaagactcagctatccctgtatggtgcagacatgacactcggcacacatagagaaacatgacagctgccgcaccctgtgtctaagctgggttatatttcacatactgtggccaagcaaatgcgggtttttggcccatcatagatgccagagagggtgtacctcctagatattcttcatatgttaccatccattacttgttcctgagtattcagtgttacctgggggcagacgatttctgcactttctcagccacctcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggactttggcagctgtcgcccccatcctgccagatctgattcccaggcacaggcttggtgtcctgtcacagtttgcatttcaaacctaattctttctcttagaagcagacaaacttatcccacagtcctctatgcatcagaagatttcaagcctccaagtggcttctgctgtgttattcagggacattctatccatggggagtgctccagtctgaagcacttcctaccacgaaacgccaccacataaagtgccttctccaacatcacacggcgaggggcttcatctcattttggaaagcagttttaagtgttcccacatttgaatgcttcagacccttgcaagagacaatttgccatggagagagagaaactcaggaaagacaagtcattcagtcactgacagttactaagaacattgccgaaaagacaccctgggaaccttcattcttagtccagagctcttttcactctaacaagcctgctcctatcgcagcctccttcctgtcctttaaaactagatagatgctgcctcttactccaaagacaaccttccatcaagggaggagggacaattgcaatactgtgacctccaaccccatgggtttcccaactccgttcttacccaggaagtcctggtcatgtcatggccacataagcttagtggcaaaaaacaccattgatacaactgtcattgtgaaagtatggaggtctggagtctctcataagcctggggttttgggtcatcagggcctatggccaccttacctgggctgagcttttggacaaggtgctgtgccagtctacacccctcagccagctgttcttggaggtcctgcccctgggacttgtctggctcatccggagtgaggagggcctggagatgctgattcaatgagcaggaggcatctctcccttcccgtaacttctcccttaactgggtcagctctcgttcctgagagtgaaccaggactttatattgcctaaggtgagacggtagagaaaatttaagagtggaaagggttgagtgatccgctcaaatattgcaacagagatttctgagacaatgtcctcaaggagacctccaagcagaaggtcagcacatgttggaaggaatgtctgtggctaagagaaagaatagaaaatggtttacaggtttcctctgtatcagagagggctcctgcaagatcctcgatgatgttccattcatctttcccttctgtaaacaaaagtaggtgtcttcctaattccatttcaaaaagacatcctttcagtccctcactctggccatggacatttccatgtgaaaatacacatagtgcatcttgcggccactagatacaaagccatgtacagaaatgaggccaggtgcagatggggcgaattgaaaagatgaaagaagaaaagaatgacagggtcgagaaggcaacattgattgagtgaaagaatgagaagacgcagtcagtcagaaggtgattctcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccataaatttttattatccttcttctctgcttgataaatacttgtgtgttgcgagcctgccatggcaattcctgcccttcccctggcccagcttagttcttaagtctccccactgagctgctgtacttcagagatttacacacctgcccccctgcctgcccccatggggtcccctcacctgagctcctcagcttgcttgagctgctctgcaagcttctcctccttgaactgtcgctcattcctcagcatagattttatgaggtctttgcactcttcattttctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagagaacctcaatggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgatggtttcccttttactgggaatttcaaggacaagtatgcaaaagattttaaaaatctttgatttttaaatcatatcttcagttatgattttaagaatcatatctgaagcataaagtgtgacacataacaccataaggccatgaaggaaatatgcccaaatgttaataaagtttgtgttaatttagaaacagcagaatgaagaactaatagatagtgtttactgtgtgctaataaatgttctaggagattgacaagaaatagctcatgtaattcactgcagcaatttacagaggtaggtattattgtagtaccctctgaacaggtgaggaaacagggacagaaaagacaagcaacttggatggagcccaggagacaggcccacggtctctgctctgtacactgcactgctatctccacacattctcgggtgcgatctttcttcctctttaggaacaagactctgtgccccaggaagcaggacttcactctcaccaagctacattctgcttcttattcttatttttatttatcattattagtattatttttttaacagtcttgccctgtcgcccaggctggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgtttcccaggctggtctcaaactcctgacctcgtgctctacccgcctcagcctcccaaagggctgggattacaggagtgagccaccatgcacagcccctactccctgctcttgatgctgtcacttatagatagcacaggttctattaggagcagactcctcttgaagcccctcagagcaggtactggctactatcaccaagtttccctcagagtcactagaacagagctttgcatattgggcctcaacagaaacttgaactgaataaaagttcactagtctcagacatttagaacaacagactagatgttatttgtctgcaggatcttacatggtacagagaggattcttgaaaacatgattgagcctcttggagaaaacaggtcattctgtgcctgtgtcagaaatcaataaatggcagtttaactctagtcccacccccacctgattgcaaacatggaaagttgctaaatattttgggacctctgtcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagcggcagccttgtctacttatttgaagatgatgtttccctggtttcactcttgtcatctccagtcttgatctcctttaagtcaacttatcttagctatgcagtcaccttgaaaccaggacataaacacttctacacttttcttgcttataagtttctataaagcaaggcttggccctgagatttttaccccatgagtggccaatgtttctgtgtagcacaaaaggtttcattttgcctttttaatttttttcttttttggttttttgttttttgtttgagacggagtctcactctgtcacgcaggctgcagtgcagaggcacaatctcagctcactgccacctctgcctcccgggttcaagcgattctcatccctcagcctgccaaacatctgggattacaagcgccaagtaacatgccagctaatttttgtatttttagtagagatggggtttcgccatcttggacaggctggtttcgaactcctgacctcaggtgttccgcccaccttggcctcccaaagtgctgggattaagatgtgagccagcacccccggtcagagacttttttttttttttttgagatggagtctcgctctgtctcccaggctggagtgcagtggcacaatctaggctcactgcaaactccggttcctgggttcatgccattctcctgccacagcctcccgagtagctgggactacaggtgcccaacaccgtgcccagctaattttttttttttgtatttttagtaacgacggggtttcaccgtgttagccaggatggtctcgatctcctgacctcgtgatccacccgccccagcctccgaaagttctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaacaatatgtgcgtatacagcctgtcctcagaattgatcttccatagcctagacagaggtatgagacacaaggaaaatagaggctacctgggagaatgtttacagcatcctgacattcatcatgagaggattctctgtctacaaccagagctgagttgactttgtcttcctcaaaggtgatgttgatgttcttgtgaggctggttggagtcacaagggccgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccacaccctgtgtctaagctgggttgaatttcacatactgtggccaagcgaatgcgggcttttggcccatcatagatgccagagagggtgtgcctcctagacattttcatatgttaccacccattacttgctcctgagtattcagtgttacctgggggcagatgattccagtactttctcagcctcctcaacttgaacatcttcatcctcatcttcgtcattttctgtaaatacaaaatgttcgttcagatatttcccacttcccattctccaagcacagtcagcccaatgtgcacagagacatgaacatctatgtgtggttcagcattgtactgaaaactgtcatgttttatctttcacaaaatgccctggcatggtttcctggtccatcgggcaatgcatttctgatctggagggccaccatcaagatgtggccaaatattgaaaagaccttttgcttcccatatcactggaggcttgtgcagcctctctctggactttggcagctgtctcccccatcctgccacagatctgattcccaggaacaggtttggtgtcctgtcacagttcgcatttcaaacctcattctttctcttaggagaggacaaacttgtcccacagtcctctatgtgtcatgagactgcacaggccctccatgtggcttctgctgtgttattcagggacattctatccatggggagtgctccagtctgaagcacttcctaccaccaaatgcccccacatcaagtgccttctccaacaccaaacggagaggggctgcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgccaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtgtagcagaaaataaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaataatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcaacttgcagccactagatacaaagccatgtacagaaatgaggccaggtgcagatggggcgaattgaaaagacgaaagaagaaaagaatgacagggtcaagaaggcaacattgattgagtgaaagaatgagaagacgcagtcagtcagaaggtggttctcactaagggtaagtggggtggtgatggcacaccattttgagtatactgagtgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccccacctgcccccatggggtcccctcacctgagctcctcagcttgcttgagctgctctgcaagcttctcctccttgaactgtcgctcattcctcagcatagattttatgaggtctttgcactcttcatattctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagaaagggaacctcaagggcacatcaaggaagttgacaagatgattcaaccacaacgaagtggagtcagaattcacagcccctgaggtctgactctgaatgcagggccactttcccaagacttgcagcctctcctctaaaacactgcactggggcatgaagtagtgatttcttgtacagtcgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggtcatgaaggaaatatgcccaaatgctaataaagtttgtgttaatttagaaacagcagaatgaagaactaatagatagtgtttactgtgtgccaataaatgttctaggagattgacaagaaatagctcatgtaattcactgcagcaatttacagaggtaggtattattgtagtaccctctgaacaggtgaggaaactgagggacagacaagacaagcaacttggatggagcccaggagacaggcccacggtctctgctctgtacactgcactgctacctccacacattctcaggtgcgatctttcttcctctttaggaacaagactctgtgccccaggaagcaggacttcactctcaccaagctacactctgcttcttattcttatttttatttatcattattattattattattattattattatttttaccagtcttgccctgtcacccagagtggagtgcaatggcaaaatcttggctcactgcaacctcagcctcctgggttcaaaggattctcctgcctcagcctcctgagcaggggtgattacagtcacctgccaccatgcccatctactttttgtatttttagtggagatggggtttctccatgttgcccaggctggtctcaaactcctgaccttgtgatctgcccgcctcagcctcccaaagggctgggattacaggagtgagccaccatgcacagcccctactccctgctcttgatgctgtcacttatagatagcacaggttctattaggagcagactcctcttgaagcccctcagagcgggtactggctactatcaccaagtttccctcagagtcactagaacagagctgtgcctgttgggcctcaacagaaacttgaactgaataaaagttcactagtctcagacatttagaacaacagactagatgttatttgtctgcaggatcttacatggtacagagaggattcttggaaacatgattgagcctcttggagaaaacaggtcattctgtgcctgtgtcagaaatcaataaatggcagtttaactctagtcccacccccacctgattgcaaacatggaaagttgctaaatactttggtacctctctcttccaactttaacaaaatgttaaaatacccatttctgttttcctagaagtatggggaggatgacattattttagatggagagagcacttagtttctcagagagaagacaggacttcgttcatcactttcgtgatggtgagcctatagatcttactgtatttgttctgctggttggccaggaagcaggccagttgagttacaaaacatttctctttgaggtttctgaactgctgtttcttctctgccagctggggatgcaatttctcgttgatttctagaatgttcatctctgccttctcgctggacaaagggccggctgataccaccatgctgacgtttgtggcagaagaggtggggccagggactggggagaagaaaggcaaacacatgatgggttaaaaactggtgaaatcaaataggtttaatcacactgagggatgtcagtggcagccttgtctacttatttgaaaatgttgtttccctggtttcactcttgtcatctccagtcttgatctcctttaagtcaacttgtcttagctatgcagtcaccttgaaaccaggacataaacacttctacacttttcttgcttataagtttctataaagcaaggctgggccctgagatttttaccccatgagtggccaatgtttctgtgtagcacaaaagattgcattttcctttttcgatatttttctcttttggttttttgttttttgtttgagacggagtctcactctgtcacgcaggctgcagtgcagtggcgcaatctcagctcactgccacctctgcctcccgggttcaagtgattctcatccctcagcctgccaaacatctgggattacaagcgccaagtaacatgccagctaatttttgcatttttagtagagattgggtttcgccatcttggacaggctggtttcgaactcctgacctcaggtgttccgcccaccttggcctcccaaagtgctgggattaagatgtgagccagcacccccggtcagagactttttttttttttttttttgagatggagtctcgctctgtctcccaggctggagtgcagtggcacaatctaggctcactgcaagctccggttcctgggttcatgccattctcctgccacagcctcccgagtagctgggactacaggcgcccaacaccgtgcccagctaattttttttttttgtatttttagtaacgacggggtttcaccgtgttagccaggatggtctcgatctcctgacctcgtgatccacccgccccggcctcccaaagtgctgggattacatgtgtgagccaccgcgcccggccgagacttcttattaatagctaagacaagccaatgaaaaggagagagagtctagcctgagaggagtgaaccagggtgggaggatcgtctcagccgatcctcccacctaagtctcctgagcagttgggactagaggcacgcagcaccatgcctgcctaattttttgtattctttgtaaagatgggtttcaccatattgtccaggctggtcttcaactcctgaactcaagtcatcctcccacttgggccttccaaagtgctgtgattatatgtgtgagtcacagaacctagctccatcctagtttctgactaaaagaataacaatatgtgtatatacagcctgtcctcagaattgatcttccatagcctagacagaggtatgagacacaaggaaaatagaggctacctgggagaatgtttacagcatcctgacattcatcatgagaggattctctgtctacaaccagagttgagttgactttgtcttcctcaaaggtgatgttgatgttcttgtgaggctggttggagtcacaagggctgtggctatttgaacaagtgatggcacattcctccagtgagtcctcagggactttgctttcttcagccttctgcacctccctgatgagccaggtgggacagagatgacagaagattaaacacagagggattggaccccagggagtcctagctggttttgacaggcggcattaagacagtggtcccagaaagcaaaatggaggttccctttaagggggaacaggcaatcctcttctctctgcaacagagcatggctgccatgggagccagagaggaagagagcagctggtgttcagtgcactggacagataggagctgaggaggatgaagactcagctatccctgtatggtacagacatgacacttggcacacatagagaaacacgacagctgccgcaccctgtgtctaagctgggttgaatttcacatactgtggccaagcgaatgcgggcttttggcccatcatagatgccagagagggtgtgcctcctacacattttcatatgttaccacccattacttgctcccgagtattcagtgttacctgggggcagatgattccagtactttctcagcctcctcaacttgaacatcttcatcctcatcttcgtcattttctgtaaatacaaaatgttcgttcagatatttcccacttcacattctgcaagcacagtcagcccaatgtgcacagagacatgaacatctatgtatggttcagcactgtactgaaaactgtcatattttatctttcacaaaatgccctggcatggtttcctggtccatcgggcaatgcatttctgatctggagggccaccatcaagatgtggtcaaatattgaaaagaccttttgcttcccatatcactggaggcttgtgcagcctctctctggactttggcagctgtcgcccccatcctgccacatatctgattcccaggaacaggcttggtgtcctgtcacagttcgcatttcaaacctcattctttctcttaggagaggacaaacttgtcccacagtcctctatgcatcatgagactgcacaggccctccatgtggcttctgctgtgttattcagggacattctatccacggggagtgctccagtctgaagcacttcctaccaccaaatgcccctacaccaagtgccttctccaacaccaaacggagaggggcttcatctcattttaaaaagcattcgtaagtgttcccatatttggatgcttcagacccttgcaagagacaatttgtttgcctttgcagatggagagagagaaactctggaaagataaatcactcactcaccgacagttactaagaacattgtcaaaaagacagcctgggaaccttcattcttagcccagagctcttttcactccaacaagcgccctcccatcacagcctccttcctgtcctttaaaactagacagatgctgcctcttgctccaaagaccaccttccatcaaggaaggagggacacttgcaatactgtgacctccaaccccatgggtttcccatctctgttcttacccaggaagtcctggtcatgtcatggccacatatgtatagcagaaaaaaaccccactgatacaactgtcattgtgaaagtatggaggtctggagcctctcataagcctggggttttgggtcatcagggcctatggccaccttacctgggctgagcttctggaaaagttgctgtgccagtctacacccctcagccagctgttcttggaggtcctgcccctgggacttgtctggcttatccggagtgaggagggcctggagatgctgattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgactgtggccaagagaaagaatagaaaatggtttacaggcttcctctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaattgaaaagacgaaagaagaaaagaatgacagggtcgagaaggcaacattgattgagtgaaagaatgagaagacgcagtcagtcagaaggtgattctcactaagggtaagtggggtggcgatggcacaccattttgagtatactgaatgctgctgtgtggttcacactcctttggttaattttgtgttatgtaaatttcacatcaacaattacttgtttgaaaaagagaaaacaaggctctaagaaacaactgcaacccataaatttttattatccttcttctctgcttgataaatacttgtgtgttgcgagcctgccatggcaattcctgcccttcccctggcccagcttagctcttacgtctccccaccgagctgctgtacttcagagatttacacagctgctcccctgcctgcccccatggggtcccctcacctgagctcctcagcttgcttgagctgctctgcaagcttctcctccttgaactgtcgctcattcctcagcataaattttatgaggtctttacactcttcatactctgagaaaagacagacacgcctgcctcagtggaaggctggacatgctgctgtggtcactgcctacagggcagaagccaggtccatcccaaggacaaaactgtcccccgtaccaggctctaggcagggatttccacatctttactcttcagtctcctgactttctggcatcttatcctccaaaatttaaagacgaagaaagagaaattcaaggcacatcaaggaagttgacaagatgattcaaccacaacgaagtggagtcagaactcacagcccctgaggtctgactctgaatgcggggccactttcccaagacttgcagcctctcctctgaaacactgcactggggcatgaagtagtgatttcttgtacagttgggaaggcccctaggactatgggactgacggtttcccttttactgggaatttcaaagacaagtatgcgaaagattttaaaaatctttgatttttaaatcatatcttcagttatgattttaagaatcatatctgaagcataaagtgtgacacataacaccataaggccatgaaggaaatatgcccaaatattttattagtatgacaggcagcatcaagatttagattagttgtgttaatttagaaacagcataagattagtttgtgttaatttagaaacatcagaatgaagaactaatagatagtgtttacactgtgccaattaatgttcaaggagattgacaggaaatacctcatgtaattcattgcagcaatttacagaggtaggtattattgtagtaccctctgaacagatgaggaaactgagggacagacaagacaagcaacttggatggagcccaggagacaggctgagggtccctgctttgcacactgcactgctgcttccacacattctcgggtgtgatctttcttcctctttaggaacaagagcctgtgcaccaggaagcaggacttcactctcaccaaggtactctctgctttttatttttatttttgttttatttatctttttgtttgtttgttttttgatgagtcttgccctgtcacccatgctggagtgcaatagtgcaatcttggctcactgcaacatctgcctgctgggttcaaaggattcttctgcctcagcctcccgattagtggtgattacagttgcccgccacgacgcccatctactttttgtatttttagtggagatggggtttctccatgttgcccaggctagtctcaaactcctcacctcgtgctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactggctactatcaccaagtttccctcagagtcactagaacagagccttgcctgttgggcctcaacagaaacttgaactgaataaaagttcactagtctcagacatttagaacaacagactagatgttatttgtctgcaggatcttatatggtacagagaggattcttgaaaacatgattgagcctcttggagaaaacaggtcgttctgtgtctgtgttagaaatcaataactgtgagtttaactctagtcccacccccacctgattgcaaacatggaaagttgctaaatactttggtacctctgtcttccaactttaacaaaatgttaaaatacccatttctgttttcctagaagtacaggaaggatgaaattatttttgatggagagagcatttagtgtctcagagagaagacaggacatcattcatcactttcatgatggtgagcctatagatcttactgtatttcttctgtcggttggccaggaagccggccagttgagttacaaaacatttctctttgaggtttctgaactgctgtttgttctctgccagctgggggcgcaatttctcgttgatttctaaaatgttcgtctctgccttctcgctggaccaagggccagctgataccaccatgctgacgtttgtggcagaagaggtggagccagggactggggagaagaaacccaaacatatgatgggttaaaaactggtgaaatcaaataggtttaatcaggactgagggatgtcagtaactgaaattcttaacttactgttgtgaaaaatgtgatcactccccacagcactttaggatccttcaccacaaaaacaaggttcgaggtgcctgaactcagagctgaaagcactgccagtagctcagactctgataagagtgaggtagactgtggccagcgtgccaggtaaccgtctgcagttgcaataacagaattagaaggtgggggtgtcatggaatcttaggagccctgcattccaattgcccaggctttcctgaaacacaggcaccctagtctcacctgagggtcaccaccaatggggatcattccttcagcattcactctcagtattcgtgtacccttgtgatgatgccacagacccgtgtctttcccaatacatctaagcatattcctcactgtttatctcttgtctgtacaacatcatcaaggcagaaacagtttcccaacaggttgtattttcttaatggtagtcatgaagtcaccccacctgctctcagttaaaacagagcttaaggcctttccacaggtgtaagatatcaaacttttagcctgccctgatttcctctgggtcttctgcagttttgtctgtatccactagaaagtgaatgaataattcatttgtaaaaaatgttgtctttcctgtctcagtattcttcttgctgtttcccattgttatgttgatttcttttttctcactggggcaccatctttgcttttcattacactctagaccagtttgacatccctatgtccagagctcttcctctatgtgggttgatttggtttttgatgtcactgagcgctacattttatacttgtcacttatggatgtcattctagtgtcacaagagctcttttcaaggtatcaagtgatcaaaatcatttatatagagatctcctgaaaacatgtgtgaccatctatcttgggaagtttcataaacctgatgctattttgttgtttccattttgttttcccatatactgaaaagaacagggccatgagcggttcttatgcaatatggtttgatatatattttgttgagatgacctaacaccattgattttgggttgcattccactaacagaacatggcaagatcaaggttatggtcacggttggttggtgatcctcagtgttgcagtagaaggtgagtttgagatgagaggaatgagtaggaaagagtgatcccctgaaccacctcctcgctttctcagctttcaccccacctaggttttgtgagcctggaacttgggagactgttctgtagcccaggtctcctaagattggctgctggacttgcctgagttgagggtgcggtgggttgaccctgggctgcccagcattcatgtggtagtgaaggaaggaggactggatcaatcccatttcaaagcatgtctctctgcactccacactgtcctccaatgacactgtaaggaaaccgctttaagacgtatcaacggctttaagtaaatgtattttctggcatctgggagacctgacattctgtgtcataatgaaaatctgtcatgtttctttattttaaaaatgataaaactgcaggttcacagagttacatggcttacttgaggtcacacggggatgagttttcagcactgccaataaaagcaatcacatgaattattcagtaattattcataggatccatataattcagtaaatattcacataattatttactagttgttcattgaccaattcgtacaaggcattttgctcaaaactgtgtttatatttggacattgtatcttcatcataatcctgtggtaatgctgttatccgtaagtaacaggtaagaaacctgaagaggagggatagcaaatcatgtatttggacatatttcctttttttttttttggtttttgtgatgctggaagaatgaccagaatgagtcataggaagagtatacattcctgtagtattttccaggacagaggtgtgacctcctagagtactgggaccaaaattcccaagtgtctgcaaccttgctttaacagtatgggagatcacctctatcacctggaattcccctggaactctggaatatacaagagaagtatgagacttgggtcttcccttggctgtgtttaattcactcttctatggaataccaatgattctcactaagactggccttttcataagcacaatgtgcattttatggagaagattttacactttgctctatttagaaagaataaatatgagcagtggtttaggttttatgccctggacttaatatgtttctgattcctgttttgagattaaattctcatgtaaatagaaaaatacttattatttctcataaggccaagtttgttattagtttgagtttttgaagatgaagcacaaacttttgattttatctttgtctgtctctgtcagcgccactcgttgtctctcagtatgacctggacttgcccctgcacttacccttgtcctgctgaaccatctccatgcactgtccaattccatcagtgattcgggctccttccaaggctccctgaaaagggcacagagatcaggacattaggcacattccggacacaaaggcaacccatactgtagagtgggcagctgtgtttccacttccctaatattccagtgatgtcctcaaactgaaaggaacactttccctttttaggggtctgttcttcatgtctcagtgcctctgatctagtcaacacaactgtcctgaatgtgaaagaacttgctaaatttctagtttcttgttaggtggctaaaatagatttataagacttccttacttacccatgactgctgaagtttgaattcttagcagtacgattcgttttcttgtaaggtgagcagcttaggaaagattggccatcttcctgtgcaaaaagaggcaaacttaatttctactcaaagcatgcttgaatttggaatcagggcttccactcttccgaagttggagtgtcactgcgacaggcatgtgtcccgaagggctcgtgtctctgctatactcaaagtttaaatggagcccagcaagccagatgtcctttacttctaggttccctcaacagtttctcctccgctttagagaccgcattgaaaatattcttgttctgctgttgtgttttggctttggaatgatgtgatgcagctcaatgggtcccacccccaacttgatcaaagtaagaaacagctgggaaagtcagtgcaaatacaagttcattgtcctccttgcagggattctgattcagagggctcaggtggggcctggaatgtttgttaacatgactcagatgtgcagtcaatttggggactcactgacagcattgaccttacagtttatgggatgattctttctgtttggtgatgaagaaactgaggcacacagagtctgtaacttgcccaagttccccttgttgtaagtcctggagccagatctcaggtggaccagtgcttctctcccctatacctcatttctgagaaaaggaaatcttctgcaatttgacttctttcatctaacacatttcctcacaacatgcagccagcatcatattttggccacttactattaaagtgagatgcttttttttttttttttttgagacagggtcttattctgtcacccagggtggagtgcactggtgattatagatcacggcaatcttgaacttctgggctcaagcgatcctcctgcctcagctttccaagtagttggaactataggcacacatcaccatttctggctaattttatatttttcatagagacaaggtcttgctatgttgctcaggctggttttgaacttctggcctcaagcgatcctcccacctaggcctccaaaagtgctgggattacagaagttagccactgaacctggccctgaaatgcttttatttctttcttttttttaatgaaaatactggacatggagatgtggaaagacaccttgctttattacttttgttgttattattatttctacagtagaatttatacatcacaaaattcaccatttttaagcatacatttcagtgtcttttaccatattccaaaactttcgcaaccatcgccactacctaattccagaatattttcataatgccaaaaagcatgcctgtacctatgggcagacactctccaattccccccttcttgcgctctctgacaaccactaatctaccttctctatatattgatgtacttgttctgggcacttcctctatatggaataacaaagtgtggtattttctatctgcttcttagaatattgttctcaagtttcatcctttctagcctgcgtcagtacttcaactttttatggccagataatattccactatatggttataccacattttgtttattcatcaactcatggtggtttaagatgtttccactttttaactattaggaataatgctgctgtgaacagctttgtacaggtttttgagtgaacatctgtttttcattttcttggttataaacctaggagtgcaattgctgcatcatatgtcactttatgtttcactttttgaggaactcacacactgtttactaacttcagtagctatatcattttagattcccaatagtaatatatgagaattccatattctccatcacttttgaaacatgtgttgtctttatttttttcttaagtcatactgctgggtgtgaagtggtatctcattttggtttaaatttacattttcctaatgacgaaaaacattgaacatctttgcatgtgcttcttggccatttgtgtgtttcctttagagaaacctctactcacagctttttttccccattgttaaatgtggttgtcgtttattgctcagttatatgaattccttatacactctaggtactagacctgtgtcaaacatacaatttggaaatagttctcccattatgtggattatcttttcacttccttgacagtgtcctttgaagcatacaagttttttattttaatgaagtccatttatctatttttcggttgtttgtgcctacttaaaaaatgtctaatccaaaatcacaaagatttgtacctaggtttccttcaagacatcgtcttttgaatgagaactttcctgggttttagaggagggtggacattgtttattgatgcctcctgtccattaccgatgtttctcttgattgttattcatatgctcaccacccctccatggagcatccatggcctgtgacagagctctggggactgatatccttccactgactttggcgctggtgagagccctggtcatgtgattcagcttggccttaacccgacccagttgcacatattcctcaggccctttagagttgaagtcgagacctctctgagaacgcttgccagcccatgctcttctaaggctggagcaaacttcctccatctattccagacagaggggactgcaggggttggactcactcaagatatctctggtgttagaaagaagacctgtttcaggctttggggaagattgttcaatatgaactaggtcctctctaattatttttaccgtatgtgtgacttctttctagaaacaagggaagaatatttatgttagaacattttgtctattctttgtcaattgttgtttatctacaattttaacatggataaaggagagttcagtgtcaatatattcttaacaactaattacggctcatgtccaccgccatgcgatcatatttaaatctgtcaactatcctgttacttaggtattatcctgttcctgatgagaaaacaaactcagaaagattgcaaaatttccctaggtcacaaaactagtgaggagaggagtaagaattagatatccgttccttttggccttcaaagctaaccttgtaccattagatcaaactgatttacatacttttgctggaattagtctcagacttgtggttctcacttgattttcccaaggaaacagtgtgccactttaatatcatttcaaactttgaaatttaaaactctttttattatacttttttgtctttgttctattccgttgcttttggtttcttctcaacggatccctcttatttatatgctaaatatttgttacctattttctgtcaattttcacctttttgagtgtttgttatctgtctgttgtatgctaacagtttttcactgaggtaaaatttgcgtagagtatactgcaaaaaaacctaaaggcacagcttaataaattttaatataattataattgtaaagtaacacccagttaaagacagagaacattttcccccatgccacaaagttctgatgtggtccttgccagtcaatactcatcccccaaatgaagaatatattctgaatgttgtcactgccttagcccctttgtgttgctggaaaggaataccagaggctgggtaagttatcaagacaagaggtgccttttgctcatagttctgcaggctgtacaagaagcatggcccccgcatctgctcctaatgagggcctgaggctgcttccacttgcagcagaaggtgaaaaggaaccagggtgtgcagagatcatatggcgagagaggaagcaaaagagagcaaggaaaggtgagaggcactttttaataaccagctcctacaggaactaagagagtgagaattcactcactaccttctcccagggtggggattcatctattcatgagggatccactcccatgacccaaacacctcccatttacccccacctccaacactggggaccacatttgaacatgtgatttggaggggaccaatatttaaacttagcagccaccatagattcattttgcttgatcatgtgcttcataaaaatggaatcattttggctgggcctggtggctcatgcctgtaatcccaagactttgcaaggctgaggcgggcagatcacctgaggtcaggcgttcaagaccagcctggccaacatggtaaaaccctgcctctactgaaaatacaaaaaattagccaggcatggtggccggtgcctgtaatcccaggcaccagatatgtactggtatctcatatgtacaggacatgtactggtatctcattgttgtattgattgatgttcctgatggctaaactgtagagcatcttttcctatgctaattgaccattcatgtatcttcttttcttaagtacctattcaagtcttttgagaaattgtttcattgtgctgtttatcttattaaacttatatatatatacatacatatatatacaaatacactctaaaaaacccctttgttggaaataaatatatctcctatattgtggtttcttttaatgttctcttaatgttccctgtttggagataacgatagataatcttcaaaaaggtgaatatacacacccacacccacccacacacatacacacacacacacacacacacacacacacacacgtgagccaccggatccagcctgttgaatttatttctaagcacaacatgtatttagatgttacttgaaatgaaattgtatttttatttcattttccaaatgctcattgctaatacacagaaatacaaaagactacttctattgagcttatattctgcaacattaccaaactcactaattacttttggcagatttttatagatttctaggattattaacatacacagtcattatctgtgaataaagacagcttcaattctttcttttcaatcttttcaatacttttatttttcttactttattgcattgatttagatctctagtataatgctgaattgaaagaataacaacagatattctacttttttctctgatttaatagaaaagcattcaatcctatgccatttaatataatgttacctctgagtttttttcaaatctacccttaatagggttgaaagtgttgccttctcttcttatcatgctgagagttttctggggtttgtttttataaatcatgaaaaaagttttcaattgtgccaaatgcttttactgtgtatgacaaggtaatcatatggtttttctcttttgccctgataatacataacattacattttcttaaatataaaaaagatttcttgaatcaagctaggacagtttttttaattataaacttttaacaaatatattgaaatataacttacatgcaattgagatgcatgaaagtgtataatcattaaagtgtataattttaagagtttgagcacactatacacgagtcaaagagaaaggacagaaaatactaacgatggctcagcacatgtggtctatcttgctgaatgctctatgtgagtttgagaagagttatttgttagctgttcttagatgtattttgcttaaatatcgacctggctaacatgtgtcattgattgtgtgaattaattttgttctagtgggcagtaaaattactgtctgatcactttggacttatgtggactggttcatgttttattacaacggattcatggaaagcccacagcatttcccaagaccctctaatttggcaggactcaatcaccaatccacccctttgtgaatttgtcagggtttgcttttaggctttagcaggttggtctacaataggccttattgaaaagtgtgacacttattcctaaagcacatccattctagtgtctcagttggatacctgggtgctaatgaggtgtgcatgagttcttcccaccatggatggcagaaactccatcatacattccccaaccctcctccacctcaagtacctctggtccaaactcaatttcatagcagccacccctctgttaaatctgttagtcttttccttgtgcaggtagagtccactccttgataagtatgcacatggaaccccacatagactttgagagctgcacctttgatcagctgtctcctcactggtgccctgccctgcagattgcagttgcttcagccgtcttgaactctgatctctgccttctcagctcagtgagctgccctgccctgagtggactctagctcactatgcagctgctgagaaattctccccaaacaactaggaaatcatggggcttcccccttaagttttctcttggactgcctgttgtacactgctgaaaacaattttacgtttgtttatggaggcagggttagtctgatatgatttattctaacagacagaagcagaaatctgttatactcttttaattactgtgtctttataatattatggtagacagaatcctaagatgacccccagtgatctttgctcttatataatcacttcctcctgagtgtagacaaagctactgaggagatgtcactcctgtgattgtgttacaatttatggcaaaaacaagttaacagatgtaatcgagatcccaaatcggtccaatttaagatagacagattatctgatgagcttgacctagtgaacgtgagttccttggagggactgaggacttcctggagagatgtgaagtgcaggagggtttccatgcagggcgatcctcctctgctggctggaggaagcatgcagtgggaacatgggaggcctctaggagcagcgagaggcccctggctgacagccagcaagaaaacagagatctcagtcctacagtcacaaggaactgaactcagctgacaacctgaggaaacttgagaggaagttcttccccagaacctccagaaagaaacccagcctaatttcagcctgtgaggccctgagaagaagacccagagaatccaggcctgaacttctgatctgtggacactgcaagaaaataaatcattcttattttacgccgctaatgcttgcagtaatttagtatgcagcaatagaaaattaatacaaataaaatggagaaggctttggagtggggacaagaaggaaacggtgggagagggatgcctgtatgctgatatggttgatgcctgtatggttgaattgggtctaccgttcctcatctaattagctatggtctattaaggtgcatagctacacacaaatattggtactacgttcaattcagaggaataagatattgcattcttgacagtagacaagaacaccctgaatttggggtcactgtatcataagtcatgttatcaggtccctctaggaaggcttagaggaagatttccaggatacacttgtgacaacattgaaggcttcttttttccccaaagggacccgatctcccctcagtcgagaagctccaagtctctgaactggatgccaggttataaattccccctatactgactccatcaggcttctgtcctcagaactagagtttatcagtaaaagatagactcatgggagtctaggcatttattctcttattttatataaatcagttaatgtgcaggaacaaaacagactttgaagaaagacactcacagttgccacaggaaaacaccttcaacatcctcatgagtcatcatgggtgttctgttgggaggacttgataggaggctttcctcctcacgggctagtgcagatccaggggaaatgtcatcaagtcctccattcggagggtagcagctgaggctgctgattcgttaggcctcctgcagctggagatgcaagtagtgcattttcatggccaccgcagggccctcagtttagcattcttcagagccagcatccaacaagccacagaagctctgagtatttccctttcttcagtcacccacataaatggcttcagggccttctggggaaggcctgaaggaagatttacagcatacacttgtggcagcattgaaggcttcactcttcctcaagggatccaatctcccctcagtcaagaagctccaggtatctgaactggatgccaggtcataaattcccactatggtgactccatcaggtctctgtcctcagaactagagcttttctaagtgtaacgtaagttgatttcttagtagatgtcccatccattacattcccagacacctcacaatgattcgaatgattagtaaccaccacatatccctgcctctcagggaaatccctcccgccttgtctctagatggccaagtcccacggcctgtcctctactcttccagaaccctgttgttctcactgacagcagggagggcaaatccatgcagcagctcccgccatgacctccagcctgcagaggatgggcgccacaggacttttaaacgcatgccgctgttcccctcacctgtgcatttcttaacgccttggtgaggagaatgtctctggatcttccttgatgggagctaaaggaacaaaggtaaataatgctatgggacccactgagaactggggctgtggaagagtggccactgaagtaatagacagatgcagctattgccagatactcagtgccagagcagggagggacagggaagaaatacggacctcaccttcctctcacttccaggatccatcgggggccctccattgctaaacctaactagaagtgtgcacgcacgggagccagggatgcattctaggagggacgagccccgagtggcatgagacaggatggaaatgagtggacagtggatctgtgggaagaaggaggggatgttatgggaaaacaaaaggagaatactagctaagaacgctaggtgacattaatattccgaagtctgtgctcatattcagcaaagaaagttcagcataaagcactaaataaggagtcaagatattgtacttccaactgttgttccaacagctgtattatgaagggccactttatttcatgcctttctaatttgacctaaagtgccaggtggcactggggctggcacagccttgctcaattatgtgttgcagagtacacagagactgccaggctgagggaagatgcaagagaatagaagagatgctctcagggaacaagagaccacatggccccagagtcaggggcagcatcagccactgtcagctgctcattttcccagacagagcccacaagcctcagccatgctttgcttctgcaagacgcttcttcaccttttcaataaacctgcctgaatttaagctgacagggtttatttctccttcatcataaatgaaattcttcaccacaacaatctccaatgaattttgggcacagcaggcaggcccatttctgcttctgttccactatctctcctgtaggttgaaaaggaggaggtactgaattacctccaaatgttcctctggctctgatattctgttattctggttcctttttggctactttgtttttggtagcgtgtatcctaaggcgtccagttgaacaacttttgtctactgtgtccaggcattcctggtggtatttcagataagactctcttgggttgctgaactcacaaccactgaaccaattctatgaccatctgtttcatggccacatgtttgctcattttatatgtacataaagggaggggacagacagcaaacttgcgtgttacaaattgtatcatcttaaaaaggaaacaaggcaacactttgcaataaaaccttaagatgcatgaaatttgagcctaatgcaataaaggatgcccataaaattcttatctaaagaatgtttcgaaaattgttgtacaaggacatcatcatttaaagtgatatgaagaaaccttctcagctaagcatatgggctagattagagagaaaaataaaggacccatctctgccctggaaaaactgctggtagcatctttcaaaaagctctctgtgtttgagtacgcaccttgatccataggctcacatttgatcccaactggcagctgcttcttggcattaacattggattcccaactagtaaatcttaccaagatctgactttctgcagatataatattattttgtttgaccatccttatcttcaagggctaccaagaaggaaccaagaatttatttacctccccaagggaaaaggttttaccaatgagaccctttctcaccatgaccccaggaccccatatgccctgttcacttgagtgccctgtgtggcctgatagaagctcatgctggtcacaggattccttatatgactagcctccttcctgaatcccaatttcatggtggtggtcatgacaggtgtcctgtatcccatgctcatgtccctgaagtcaccagcctatctccagttagaaaaaattacatgtatatagagaggcctctttggaaggagcaaaagctttctcaccttcgtacactaatggttggaaggtacaacagcatatgcactttgggaaaaaatatctggcatattcttacagaaacaaacaactacctattctatgactcagtaattcctaagcatttatccaagagaaactaaaacctatgtccagaaaatgacttatacaagaatgttcatagcagttttattcataatacaaaaaactggaaacattcaagtatctgtcaatacaagaatggatcaataaactgtgatacactcattccatggaatggctaaaggaacaaactggtgacacacagaacaacatggatgaatctcaaaaacatttggagtgcgatagaagccatacccaaaaaagtgtgagaaaaaaagataaataataatggttccaagaaatgcacagcagacagcccagaggcaaagacccacaggacggcgggccggtcccaggctgtcgatcctaattaagaaacttctgctggattttgcccagctccatttccaaactattttgggtcagtgacttctttatcccttccatgttgcctcattttgaactagaatcactgtaagtgttattctatgtctgtcacatcattccacagtaggggcagataagctgtttagaatggctaaaattcaaaaaggtgaacacaccaaatgctgtcaaagatgaggagcaaccagaactttccatcgctagtggaaatcaaaagggtacagtcactttggaaaacttaagttcactcaaaatcctgcacagaagtacttacagcaattttattcatcatcgccaaaacttggaagtgcccaagatgtctttcaccaagcgaaagaataaacaaactgttgtagccatacaaggaaatctgattcactgattttaaaaaacaagttatcaagccatgaaaagacatgaaggaacttaaagtacataatgctagaaagaagccagtctggaaacccacatactgtaccactccaactctaggacattcttggaaagtcaaaaagatagaagtagtaaaatggtgagtggttgtcaggggtggaggagaggaggacgcgtgaaatggtgaagcacagggaattttcagcagtgaaactctttcgcatgatgctgtattggggatttaggacattatgtaattgccaaaacccataatctgtgaaactcaaagaatgacctctaatgtaaactatggactttagttgataatgacgtatcaacagtggttcatcaattgtaatgaatggaccacactaatacaacatactagtagggaaaattgtgtgctggaggacaggggagcctaggagaactctctgtattatccactcaagttttctgtaaacctagaactgttctaaaaaataatgtctattaactgtttttttaattaggatgcagcagccccatatcaaggttttggtggcatcctgtaattgtgtggttagtacttggcattgaagtgcaccaacctggagtcagagcagttggagatttcaaggcctgtgccatttacctctaaccctggggtgcccctggaatacagatagcagatcggttaaggagaagcagcctcagcaatctagacagtgcaggtttctggtgaggacaggtaaaaaccatctgggtgggcagaacttggtgaagaccagaaaccactgagactcagcagctgccgcagtggcacccacaaatcaaaggagggggctgggaagagctaagggctactggatgagctctctgcctgcaagacagaagcagatccagagattttggaaaataatgtaggtttcagtacagtgtgatctcttcaaaaaagtagagagaatgaaaaggaaagaaaaagagagagcatgagagagaaagaagaagaaaagaagaaaggaagaaaggaaagaagggagggaaggagggaaggaggaaggaagggagggatggagggcgggtgggaaggagggaaagaataaaaagagagagaaagagagttggagggaagtagggaaggaaggaaggaaggaaggaaatgaacaaatttacatgaagatgagaacagtggggaaacttacaccaccaatattttccattaacaggaacacgctaagtagttattagagaaagacacgctactgtaaaacaatatactgtttccatggggtacaacaaccccttcctcctcctctgaaacacattctatctctggctcactgttgccagagacactgagtcttgtctttggatacgttctggtgcccacaagaatgagatgagacagtggatcccagaacaccaggccacgaacttccctgttgctccttgtccactccagaagctacccagctgcagttggggacctcagcccctgggtctgatgtcatccatttgcctttctcaatggacttctctccttgcactggctcctactcccccaggacctgtgggtgaccacatgagaagaacacaaacaggccatgcccctttctttctccccctctcaatgcctgcagtagtgggttccatggggtagtgacctgagatttactcattgtggggcctctagcccagagcagggcctactacctcacagtcaccccatgaatgctcagtgaaagaagacgtccaccacaaggtcctggggaaccaagaattccactgtggcccataaattctaagtctacaggattctggaatgggagatgggaaaggccttcaaaagtggccacttttaacccattatactggcaactgagccatgtttccccatcctggacacatccagagggcactgcctaaaaccagacacatctccccacccaggacagtgtaggagccttagcctgggggatgcaggtggacagggagggggtgagccaccaaagctgaagagcagaaagcaggtgaaaggggacagcagggtggaaacagagagaaatgggggcagagaatggggggtgagaggggaagagtgaggagagggatgcagatctagctagtaaggaaaagtcctggagagaacactgtcctctcctgaagtaaaatcacttctacctgaccacggcactgcagctcatgggcagcacatgctgtggatatttgttcattcatttaacaaatatttatttaatatctgttgcatgccaagcaaggccctgcaatgtttagggaccttgacatcttcccttcacatctgagtcataatacaaagaggactctctgaccccactgagctggcaatgcctcgggatttttacctgttggatctggcagctcttgatgtcagcccacaccatgtgaggctgctcttggtgcacccaatggggaagtttctacatcagggcctcggagaatccactggaagccctggacagtgggagtcagcggcatccccagtgtggaggccaagagcacacagtgcttaagctccaggcaccctcaggaggacggcaagggacaattggctggtgagagcccgggtcaccgggaaccttcgcctgggtctaaacaggatttgccttcagattgcctgtgagataaaagagagaaatcaaggttaacgttgagatttagggcttcggtaacttgaaggatggagctgccatttacggagactgggaagacccagggaagagcagattgaaaggtggtgggaactagaggtggttgggtttctgtcatatgtaatcaacagtcctgaccagcctgggcaacatagtaagaccccgtctgggaaaagaaaaaaggaaaaataagctgagcatggtggtgcacacttgtagtctcagctacttgggaggctgaggcaggaggattccttgagccttcagttagcggttagtgagctatgatggcaccactgtactccagcctggggggaaaaaaataaagagtcctgactaaatactagagtagccagggaagttttcacaaagtaagtaatatttgaggcagatcttagtgaacaagaattccattatttctgttagggaattaagagagtgtgggtgtcgttagttaatgcttattaaagtagctttggaatctcatctactggtctagctggtctatctgtacacgtatattgtatatgctgtctctctgagctttcgctaggttatgctacggtaacaaaagccccaaaatcttagcagctacacatacgaaggtttatttttcattgacatgtccttttatggcaggttgactgtgactctactctatacaagctactttatttgttagatggtgaaaactgtgatactcggaggttgttgaatatggtattagtatgttcattcattcattcatttaagaaatatttattcaatatctgtttcatgccaggcaaggtcaagtactgagaatacactggtgaatcaaagagacaaaatctctaattgccaggagcttatattgaaaatcagattaaacacatacaaaatcatcataataacaacaatgaatactatattcataaataatagctgtaagagattttagtacatcttttaaattagaaaaatataaaaattattaaaactaaaatggccaggtgtgatggctcatgcctgtgatcccaacactttgggatgccaaggtgggaggatcatttcagcccaggagtttgaaaccagtctgggcactacaggaaaaccctgtctacaaaaaggagaaaattagccgggcacagtggtgcatgcctgtagacccagctactaaggaggctgaggtgggaggagtgcttgagcctgagagatcaaggctgcagagagccatgatcataccactgcactccagcctgggcgacagagcgagacactgtctcaagaaaaaaaaaaaaattatttgatgtagtcctaaaactattatgtagaatactattgtttatatcacagcacgtgagccccttaaatggcttaacacttatttaggtatgatccataaagcttttctggtaattaagtatacttaagaacaattaagtataaaagagttactgccttgacaggaagattgtaaaaattttaaaaagacaaataaataaaagagtaaaaactgtagctctgtgaggctcaaataacatctaattcaagtcacaatgaacatctagcaatcattctgaacaccatataattcacttaatacgttttgcctgaacacccaacacatctgaattaccaacacccatatgtagccaagaaactggcaatcatttataaattatcacctatgactccatctgctctacgcacttattttttaaattttattcatttatttattatttttatttgttgtagagatgggatctcactatgttacccaagttggtccagaaacagaaacagacccacactaatttcataaatcagatgaccatacagtcattcgatttatgaaaaaaagtgccacatggtgcggaaggaaaaggatggtcttttcaataaatggtgctggatcaagcagacacatccatgtagtaaaaagtgaatcatagccaggtggggtggctcacacctgtaattccagcactctgggaggctgaagcgggcagattacttgagcccaggagttcgagaccaacctgggaaacatgttgaatccccatctctacaaaaaatatgaaaattagccaggcatggtggcacatgcctatagtcgcagctactcaggaggctgaggtgggaggatcacttgagccaggagatggaggttgagtgagctgagatcctgccaccacactctagcctgggcaataatagactgaggccctgtctgaaaaaaaaaaaaagcaaaaactaaaataaaatcgttataaggttaacacagaaaaatgtgttcatactcttaggttaggcattgatttcttaaacaggacacaaaaaacagtaaccataaaggaaaagattaataaagtataatttcattaaaatgaagaatctcaggctgggtgcagtggctcatgcctgtaatcccaaccctttgggaggccgaggcaggtgtatcacttgagcctaggaattccagaccagcctatgcaacgtggcaaaacccatctctactaaaaatacagaaaacagctgagtgtggtggtactcccctgtaggtcccagctacttgggggctgaggcagggggatcacctgagccttgtgaggtcaaggttgcagtgagctgtgattgtgccactgcactccagcctgggcgatggagtgagatcctgtctcaaaaagaaaaaaaaaaaaagagaatctcccttcatgaaaaaacaccataaaagagtgaaaacgcaagctacagattgaaaaaagggaaatgcaatacatataaatcctagaaaggaggcatatccagaataaagtattacaaatcaacaggaaaacaagcatatcaatgaaaactggataaaaagatttaacaggcacgtcacaaaagaggacatataaatggcaataaaagatactcaatctcaatgaaaccacactgatatattactgcacccctactagaatggcaaaataatttttaactgacaggtatcagcgaagatgtggggtaaccagcatatccctgctaaatggtacaactactttgggaaaatgttcaacaatatgtaatactaaagttttatcattcatatacctctaaaaccaacaatgccacccctacaaatataccccagactagtaatgttcaatttcttgatctgtggtggttcacttggtaaaaattcattacttttttttttttttttttgagacagggtctcactctgccatccaggtcggagtgcactgccatgatcacggctcactgcaatctcaacctcccgggctctggtgatcctcccaactcagcctaccgggtagctgggactacaggcacacgccaccacacacagctaacttctgtatttttagtagagaaagggttttgccacattgcccaggctggtctggaaatcctgggctcaagtgatctacccaccttggcgtcccaaagtgctgggattacaggtgtgatcactgcgcccgggccacctgcacatgtaaaattgtgaacttctgtatacttcagtaacttttccaagatttctttgacgcaaagttctcagaaatcttaaagctagcatttcagaatagaaaaagtagcttctggttcactagtgaaattttaccaatagaatttaaaaacaaaaagctactaacgcatatcagctcagaacactaccagcagatcttttctttaacttcctgaagcactgggattcattcttttggcaaagaaaggatgaacaacactgtaacccaaagaaaagataccactgccagaaaagacttcttttcgaaagcagctctaagcaaaagataggaggaaaacaaggaagccaggccaaacgtcttggttaactctccgctgaaaggacgccacatgagatgatctaagaagccagccagccagccagacgcagggaaatcacagcaactctttggagtgcaaacagcaaccccacaatccaatctacccgaaatcctgcggttcatttgaggcttgccccgctagtcaggaggtgattcagtgatggctacaaatgctgctcatgtgcatcctggagctggcacacctggcttgcccatcaccagcctggagacaccgccaggagcagaagcccggaggccagtaaagaccccaactttgcaagtcaggggcgcgagcgcgctcgcctctcaggtccgcagagggaacggatttctggcctggagggtggggtgcggggtcagtgtcctctacaggatataggaggacgtgcccccgaagctgctccgtccctccaccccctgggatgccacagaacacccgccagcgagtttcttccccagcgcccacgagagttgggctgcgggcggcagcggcaggcgaagaatccagcgcggggaactcaggccccggcggtgcacgaccccccacagcccccacccgcccccgcgctcgcgcaacaaaacttgccacggccgcgcctcgacccagctgtgcgcccgcgggtcccggattcaccgcccgcccagcctggcgcggcgccctcacctcagaaacgctgggtggacttcgcgtaacttcccattcacagggcagccggcagccgcgccgccgcgcctcggcccagctcctggcgccgcagatcgcccgtcccgcgttcccaaaagcaccgcgctcgctcagaagctcgggcagcct

SEQ ID NO: 146 - DNA, 180009 bp, Homo sapiens
gccgggctcctcccgccgccgctgagcactccgcagctgggtgcgcacgggagcctcaaccgcggcgcgtggaggcagtaccagagcgcgcggcgcgcagtcggccggcagccgcgggacagccttggcagaacagccgcggcgggagccccgcagccccgggctgggcccgcgtcccggagcgccaccggagagcgaggacgacgtggaggcggagtggcgcccggcgaggtagcgccaggcgaggtagcgcgagcgctttctctctctctcccctgcccttccctctgcgtccgtcgtcggcccccgaggcgcctgctccgcgcctttgtgcccgcggtccctggccccgtcgcaccctgcgggcgggggtcagcgggctctgccgctctcttgggagacgcggcgctgcggcgggaacggcgcacgctgtaggttgcggagggtggtcgtgactccgcagtggcttcgggggtggcgggagggaagaagggcttgtaaactaagttgctcttactttgccccatgcctctcgtacctgtgggcagagtcgaatctcggctgtcctcgtgttcacccacagcccctccattcctctggcccacagctgtttcctggccccctggaaagacacggtgtggcttcctccgggcaggaaagcggagggagaacaatggggcgtcctggggagtggggttcaggtgcggtgtgccccggcggcggcgggggaggaggggcccgggacgctgtgggcctccctgcgcgtgcagctgcgctcgcctcctttgttccgccgcagcggagggggttgccctgggtctcgtttcctgcccgggatgggattgattcacggtcccagagagggaaggggaagggggcggggctggaatggaaaccagattagagacgggagctacgaagggtggtggggccgggaagagagttggggagagggttgggagagggtgatgagagcgcgctggagaggtaactacaaacacacaacattttgttcaagggccatgtgagtttctagagcttatttgtagtgctttgttcaggcttcggcccagcgtttattgctgcaacaagttgtgtgcttcttgagtttctaggcgttcccaatgttagattgctcaaagcaaatcttcttagttacagtgaaagaagcccccccccctttttttttgagatttgaaaaaattttgctatgaactatggtattggtgtgtatgtgtgtgcctctgggtctgtgtgtgtagctagtggatattggctggaatgggtaggagacaaattttatagaatcaattttgacgtaaaattgttttatagtataatatagtacaacagttttccaggactgtttgagggcagaaaccaccagaaaattagacattgctataaataaatgaatcagactatgtaacacaattgaaaaacccttttacagtctgtcccaggaaacacaccacacacaccagcgtttggggtttgaactgaggagccctggcattgaagtgttctgtgctttcactctctgtgtgaggatcgtttagaggtggtagaattaaatgtaatgtgtcagacatttgttaagtgacctttcctagattggaatcgagactcgccaaaggattggctgacctagggagggagctatgggggattgaatgatgtgtgttttttgaatggggtattccaagcaaaactgttttgggaggaggctgacatttccaggcattcatggtttgtgcctgtgggacactggtgggaggattcccaaagtcggactgaaggttagcattactgtggtgataatttaggagacattctgttgtagtagtctggctgcagacagggctgggaagtggcccagagctgcctctttgacaagctgagggtccgccattaaaccacccctttggccatttattttgagatgaaccaagtttgaaagcctcttaaccttagaaggctaattaggagcttgctgtgggggaaaaaaatatctcctgcccactaagtggtaatggaaaagagctgtataagctactgctgagggtttgtctttttcgtgggggatgtggtcaaattttcaggccaggctgaaaagcactgggagttgtcctcaggagccattatgatgtgaagttgaaatgggatggtgtccaactgtcaagctgtttgtcattagaactaacacactgcctggcaaaacgttgtgctagggcagctaacagagggagactttttgttgttgttgtcttaccattttggacttttcacttatgctgtgaattgttttataaaatacaacacgattgaattcctctcaagtactcattgttctatacattaacaaaatgtaaagcatctgaacattgctgctactggagatgtggacagatagcagaatcctaagtggctggtctctggtctctggcctctggccgttctggtggatgcctgattgtgtgataaggctggcaacaggctgtatccccttcccaggatgaatcatcactttgtcaagcctggagttaaagactaacttaccctgattgctgcacagttatgcaaagcaaggaggaacgtctgacatcatggggaagaagagggagtgaggtgagtgggtggtgtttggctaagaagggatcttcagcatgtagcatccatgtttttagcatttgtcctcctttgggtaagattgtcttctacctcccttctactgttttcaatagctgaacatttggattttaattaaatagcctaacaataattatagctatcatttagtatgtgttcattacatgccaagaattttacatacattactatattcatcatcacaacaacttgataaagtgggtgttatcttcattttccagtggaaactgaggcctggaggagttaagtaacttgccccttacaccgtacagatgctcctagatttacaatggggttatgtcctgataaacccatcataagttgaaaatattgtaagttgaaaatgcatttaatacacttaatctaccgaaccttaaatgtgtccagaacagtcacattagcctacagttgggcaaaatcgtctggtaacacagtccactgtagagtattggttgttcatccttgtgatggtgtagctgactgggagctgcggctcgctgccactgcccagcattgtgatggggtatcgtactacatgtggctagccccagaaaacatcacaattcaaaattctaagtatgatttccactgaatgcctatcatttttgcaccattatagagtaaaaaaatcctaagttgaaccattgtaaattgaggaccctctgtgcttgtgtagctaactactaagtggtggaagtgcgattggggatcccaaagtccatactctttaggtatatactgtatggtatgatgtattttaataataacaacagtttgattatctagttggttagcccctggcagatgtcaaattactttcacgtctattattgtagttgattcttccaaaaaccactgtgagataggtttggaagcccaggttaggacattacaactcttagaactgtattgctaaagagctgtatgttatggcctgtatgaataagctgtaagtgaatgaaactttacttttaaaaagttaggttgccaacatttaaaaataagttcttttttcgaaacatttaaaagtggtagaacagagtagatcttatattgcactcaaggcttttatgtttattgaaatccattttaagccctttttatcttacagcctttaatagaacattgcactttgcttcttaactgagacccgatgccagagtgtctttttaagaagagaaataaggagggaaggaatgtgcttataaagaggaagtgggacatcagaattggaaacactcgcagcagcaggccatagatttttcccagcacatgctttttgtcctggcagtagccttttacagaaggcattcttccttagggaagtgtcaagggtctttctttacagtatcctctgagatcatcaaatttctgagctctgtgggaacactcattccacatgatttttgtgctcatcccttccccacaggggaagtgaactagtttaggcatctgcatgaaaagggaatagcagtggtatctgtccttagggtggcactgagagtggcactgggcaagaggtaccagactttgacaccaagtacaggagcagactggagtttaacacttggcatcatggattgtttgtggattcctcagaatgctcctgggcaaatggaaaagtcaatattaggtttttgttgttgttgttgtttctaagataagaatttgaagactggaagttctgccttgtttatttatttcaagctaggacaccatttggggtcttcaagttctgtggtataggtgagagtaactttagtctcctcaggctatgaaattctcctccactggctattttagacttttgcctctggaggagaggcagacacatggtttgctaaactctaacaggtgagcaccttccaacttaccataagcagcatagaggaggaaaaaggatgcttcccagcattacactcttacagcctttggtaggtctttgcagttgtcagcctcttcctcatcagttcatattttattaagcacacaggtcatgcaagacaatgcattagacccattttaaaaggaagaaaggaaatccattgtgctttcagggtcgttgtagcagggcaggtggatgcatcccaagagtggatgttggtgaaatgaagaaaatggctatgacagctgtagtgaccaagaccaggggaacacttgcttttgagacaaaagctgagaacaaacagaagcaagagagtggaagaaaactgaacacaggtgccagcttctctgacttaggttttatttcctccaatctccaatgatgtgaaagcgttcaggttcagaaccctgactgaggtccaaaaaatgatatataaactaccattctatgcgagaaggtttgaatagcagtgtcttccctggtgcatggcaggtccttggtacctccgccaactctcttctctacacacctgccagcatcccttcctcatcctgtgttcaatgtggctgtcaactaaggctgttaatagacttcaggcatatttgcattttaaaaggctcttgtggacaagacatgccaaatctccaaagaatgagtcattcacattgagttatatgatattattcatgctactgtttattaagtattgggtgcttgctttgtgctaggcctcatgctgggtactttctgtaggttgatttccttctcatcactatcccttagtaggaggtatttgtagatgagggaattgagtcactagcccagaggtcaagcctcaaagacccctttgctttccagaacaacgaagtgccaccaggtagagtgtactgtgaagctttgaatgagtactgtggagctttgggcaaaaactttgattctttgggtgagtactttgatgctttggtcacttttaaggagttctttttaaggagttagagggagagcccagctgttgtccctctccttcctggcttgtttcctttgtcacctgaagtcaggattcctgtaggtgtccttggctggtccaaagctaggagaattggttgaactgcttctcagtttatccttttctgggtgttttggcttcccagtcctgcgtcattctccttccccagctgagggagacaagattcagcctgctagtgagagactgaatagccagtcccttttcttacccccttgctggccatgcctttatcttcaggaatagattgtcatctgggagtttcagggcgtttgtctgatctctggtctccagtctgcctgcgagcagcatgccacagggcatccagtcctggagctcgctcagatctttgatgtgtgagaataagcggtgtggatgccattgcagagctgggttttgggaagagagttggggtgaaatttgtactcttccaagataggcagttttataaatagcagaaaagtaaaaattgacattcttcttttgcttatcagataagcacctgataagtttctgaaaatgcaaggggcctgtctttccttgatagcttaagagaggcttaagaggaaaccaaatctctgccttccggggactttcagtccaattcttcctggactcaagatgctttaagattgcacagatggcttaagttcgctgtgttaaaatgaaaatatagtaatgtatttcagaattgtacattacaggtttttaaatttgtttaaaaaaagaatgcaatatctttaaagactttttagaaaattgaattgaaaggacagtggaacagattattagttatcgacattataatacatttacacgtcatttgcctacttaattttcactggttacatgaaagcattttcacattgcaaccacaacaaaaagctcccccaaaatacacaaagaatcttaattgcaagattcctgctggtcccacttaacattttccagtgtacaccttctctctccatcattgctgctttgctttacattttatattagatcctgaattgctatttgtgatgttcagattgcaaatatactagcttcctaactgatcattttttcccttaaaagtacttcagagtgattggtcactgttttattcattttagacccacagtctaaatgctttaaggaaaagcttaattttcatagacattgggcctatgccaatttgcatggcttgttatttttgtgatcctcatattatctgcttctagtcataatcggtagatcacagttttgagctacccctgatatagtgagccatctatgaaaaagttctcgcttgcctgaaattttcaaagtgttgagagctattcataaaaatgtatgaactgccacgttggtcaggttcagggcttatttgccgtagtactctgcaggtattctgtgacattcaggaaggaaaatagagttagactcctgatgtcagctttgtaaaggttcatagatgtctcttgagtatctgtaattacatgatctcttaaaaacctcttatccatgtactgaaattcatcttgaattgtttatttttatcctgcattcacacaattcacactttaaagatagaacttgattatattggtatttttatttcaaattttcaatttttggaatggcagaatgttgctattgaaaagtgtcttaaaggtcaccactgtaaccccttcattgtgcttgagacctgctcagctcctaaatttaacaggggacggatctgagaaactgactccaagttgtaacctcttgcttagttttctttctagggagatatccgtctctccaaacctgtcgaaatctaaatttattacctcttacctaatacttggtcccctgtggacttcacttcactgtttgtgctaatagccttttcatcaccatcttgactttggattctagagcatcacctacttccccattttctgtgacccttacattcctcctgtcagtcactatgtctgatttattgttctcccctatcttttgccctttgcaaatcctcaagccctcattctggttcagacctttaaaaggctgagttactggagtatagtgttacccaaagtgagttgttccataaaaaattagtaagttggaaaaaaaaacaaaaaacaaaaaaataccctacccataaagttggtaaatgttcctgtaaaaagggttccttggccaggtacatgttagaatagctggttaagtttctttgcagaaagacttctcctggccttcatttgtgactgtgtactgtgaattcccaagagaaagatacagtattcacttgtcccaacttatgtcaccattgtaccacgttttggggggatcatttcgtagataacactgctatagtcacttcactgtagctttttaggttctgtcactgcctggcttcctgtgggaatgtgcattccatgtgagccgtacttggttcactctcaactgtgtcttgtgcttttaccttgttgttctggatcgttccttccccccagaagcccctctcccctatcacactggcacatctttcagtgcccagctttgtgcctgtcttctctgtcagttttcccagactcaggttgcgcttgttcttctgaacttaactgtttcacaacttaaaaaaaaaaaagaaaatatttgaagcacaatgaaatgttgaaagtaaccttacacattcatatggttaaattattggaattcccacaaaattccattttccatatttgcgtcagttgacacatcacatgcacatcacattctcctctgtttccccccacaggttagcttgcacatatgttcaacaagcttgttgcttgtggggcttttttctttaattttgtgttactgaaattgtgttgcatttaaatagaaattcagggagaattgacatctttatggtttaatggcttcccatccacaaacctcataagcttctttaatagttcttttatgtccttcaatgaaatttttatcattttgtatgtaaaactctttcataccgcttgttagatttgtgccaaggtgcttcatggtttctgtggtcattttgaatgaatgatttagtacatttctggttagtgttgctggtgtacaagaaagggattgattttgtatttgtttataaatagttcttgattgatcaagttcacatctaaacctgtgtttgctgtgggagcctgcagttgggtggcttttccaatacagcataaaataacttagcctttattgaaaatgtcataattcactttatttttatttatttatttattttttgagacagagtttcgctcttgctgcccaggctggagtgcagtggcataatcttggctcactgcaacctccacctcccaggttcaagcaattctcctgcctcagcctcccgagtagctgggattacaggcatgcaaccaccacgcctggctaattttgtatttttggcagagatggggtttctccatgttgagactgatctcgaactcctgacctcaggtgatccacccaccttggcctcccaaagtgctaggattacaggcgtgagccaccgcgcccggcctcttttttttttttagagacaagtctggctctgttgcataggctggaatgcaatggcatgatcgtagctcggtgcagcctcatactcctggactcaaatgagcctcccacctcagcttcccaagtaactaggactattggtgtgcgcctccatgcccaactaatttttaaattttttgtagaggtgatgtctcattggtcccaggctcctggcctcaatcagttctcctgccttggtttcccaagtgctgggattacaggtgtaagtcaccacacctgacctaatttaaaaattatatgcagtacttttagaagtaaggaaggggtgacttttagttatttaatgtgttcatttattaactcatcaaatgtttaggtgcctagtatgtttcaggcaccgtactaggtactgtgtttttgtttttgtttttgttttagagacagggtctctctttgttgctcaggccggagtacagtggtgtgaacatagctcactgcaggatcgaactcctgggcacaagtgatcctcctgtctccacctcccaagcagctaggactacaggcagcatctccacaccccactcattttttacatttttttgtggagacggggtctttctatgttgcccaggctggtcttgaactcctggcctcaagtgatcctccctcctcagcctcttgaagtgttaggattacaggtatgaggcactacacccatcctgtactgaatctttaatgttgaacaaaacagatgtggtttctgctctcatgaatgtgaaggggaagagacattgtggaaatggacacggataaatatgtattcgtggattagcatcgatactgtgaaggaaaaggacagggggctgtgagaaacagaaaggcggagagagggaaatttagattggggtacaaggagagcctgacttaggaaataaacattcacacagctgcctgaaggatgagttggtgttaaagaatgaggaggatggaagaactttgtaggcaataaaaagaggctcagaagccccaaggtgggactctactctgaatgacacaaagatgggaattttagtgactgatgacttaaatcaagttattaattcttagtaaattatcataatagtggtatttaacagtgttttacacactattatgacaaagtgaaggtatttattttttatcagtatatcctcatcctgccaagtgaagctggctagattcagagagctgcctctatggtgaggcttgaatggggccactgcccacacccctaccccctctgcattttgagtattgccactgctgctgccattgggtcctggcatctgctggacacgagcgtcctgctcagcaattttctcctgagctctgcactaatagacggggtcctttaaggtcaggtcaggtcaggtcggaagaagactgctctgcccttcctgggaggggtggtgagcagggccttctatgttttttccagtgtctcagccttctccactctccctccttcactgtctcttaaacacacactgagggctcaggcatgacaatgggatgggatccaaactgagttacacacctgcctagaatctgtgctctgtttggtcattgaagcattgctctggggcaggcatgactgagcttagttgagataagtcctctgtatagtgaaaagctatgtggtgcagtggttatgggctgggctctggagacaatactggtttttgaaacttgactcttctccttagtagcccccggaccctgggcttgtagcttaaacggtctgcctccattttctcatctgcgcaatgtgggtaattttgcagagctgccttctttgggttatagtaaggattaaatgaatcaacacatgtgcagctcctagaacagtgtcaggcacagagcaagcacttggtgtagatgttagttactactattcagcctttcctgcaatgctttcctggggttcctcctcccccacaccagatatttaaatctgtttgaatcctagcagtgcacataatttaggatttcatacgagggacccctttggaaaatatggggagaaagatggcaaaaaaagaaaccaaaatgttaagtgattgtgttacgataatagattggggtgacttttacttttaactctctattttctaaatcttctataacctggttatgttacctctgtactaataatataataaaattatttgaagaaagaaaagtcaggctggcggtctccagttggtttgctaaaaagggacaggagagagtgagaagccaggggtaggcctgctctagtggcattcacaggtgaagtaccttcccatttgtgcttatagttgcagaaactaggtaacggtgttgaatagtctttagcagaagtatccccaaaagttagaagatggggctattccttgtgaatcccccttttctgtgaattttttttttaatctgtcattattttccctttttgtttgttctgtgctcccttagtggtcctcttgccatatgtctctcattcagtcccctcttcctcccccttccccttgaaagtctctccttttaatccatcttctttacctactgtcatgcagaaattatgcacccatttattcaattcaaaataaagcatcagttttatttttattgtcaaaataagtaaatataacttttcactctcagaaatctaaatgaagttgccctttacttacttacacctaaattaattgattagttaatttatttgctgacaaattaatgaactctgggggtctgtgacctcctaaaagcaccaggaatcttggaagattgggtggctgcaaggaagggaagattgaggggatgttgaagttaaatttttcctctttgcctattttgcatagggttatctgtgttgctgccattttggtatatgtcagaatttttgaacttttccaacagaattctggaaaattaccaaaatacatttttacaaagaaaccatgccaaatctgacaaatttcttcaaaagcccattgattttaatcactgaaaagttcagcgaactttccagcttttctttcatgctgctctttttatgtaattgtgggtggagaaatggactttcctgcaaagtgtgtttatctacaggaatttattcttggcagtggcattttataagtatcttaaaaataatgctgacatagatttgaaagaaggtagtgggttacagtaatgttacctgctatcagctgaagagctgtttacatgaggaatattgctaatttaatgatgctacacaattgagtgtaaaatctagtggaggacatttaaataaacggaagtaaggtgatgcctttctgtaccttattccacaatttaggtattttatcttcaatgacaaatgcctaatttgaacatatcataaatatttatgatagttctttttctgctttaaggaagtctgggacaattacagtaaaatctagttttataaaatgtgtatacctagacttagcattggttttttcaaaagaagacatcataggaattttttaaattagaaccaatatatgtatcgcttaatgatgggtatacattctgtgaagtgtgtcatcgggcaattttgtcattgcgcaaacaccacaaagtggacttaacacaaacttagatgggacagacaaccgtatacaggtacagccaacacaagtatagccaattgctcctagtctacaaacctgtacagacgtgttaccatactgaatattgtaggcaattataacacagtagtatttgtgtatctaaacaaagagaaggaatagtaaagatatggtataaaagataaaaaatgttacacctctctagggcacttatgaatagagcttgcaagaccagaagttgctctgggggagtcagtgagtgatgggtgaatgtgagggcctaggacgttactgtacactgctgtagactttataaacactgtacacttaggctaccctaaatttataaaaacacaaagtaattgcatcatgacgtcactagtcgataggaatttttcaactgcattttaaacttatgggacctccattatatgtgtggtctgttgttgacagaaacagatgtggtgtgtgactatatcccctttttgagtagggcagcggttatagctgcttatttgcttttgtcacagagctacatgatgttggcatgaccttgtatctccacttcatacacactaatactgtggaggaggatcaagtcgttgggtttagcctaggcatgccaagggtatggcatgagcatggaacacataatgctagaactgccagcccagtcttaatacttagcactggttgccagtttaaaaaacaatacaaaggtataggtaaaatgttaaaggaaacttgtactaatttatgtcctttgaagtgacctttttgtgtctcatggaccctgggctgtagtacctgactatcttctgcaactcggatggagaaaatgccccttccttacctggcaggcagtgagccaggctggacattagatacatagtcgacttcacctactctgtgatttagcttccagctttaccgtttgctgtcttggcagcagcttgtgcatggtgaacttttctgactagaacagttaataacccccacagatgttgggagcccagttttgcagctgttgatatgtccagttggatttcttgaaagaattaatcaattttgaagatctcatgccgtgggctgcaagcataataggatttagggggaaactttattttatgggagtttgagttggtattgcaacagatgtagcaggaggttgaacagcagctgaagggatgcaggaaaatggagtttaaaaagatgtttgtgggcctaccactctaaaagtgtcaactgtggtcatttctgaatattcttttccaggctttttatgtgaatgttttaaaatgtgatcataatcatagagtacatacattttctatattgctacatagtatttgaaataaattttatagttgtgtattattccattgagtaccatcattttctgcagcatccctttatttttgggcatttgtattccttctgccactttgctgttgtgaataatactgtgatgagcctttttgtacctataaccttttctatattttgaatgattttctgacagtagatattgagaacgaggtgattgggtcaaagattgctgtgaactctttgatgtaatcaggtaatggatggagtgacttggttggtggggcagaaagagttggagtctgggataactccctagtttctggcttgtgtgatgttgggaatggtttgcatagacagggccacaagtgaggggttcattttgggatgtggggcattcaggcagtgagggagcttcagggactgttgaaatgcaaggtccggagcttagggaaaagccagggcctggggttcagatgaggggatcatgggcagctacgtgtggtggaagctgtggataatgttaggattgcttagagggtagagtgagaagaggaaggcggaggatagaactctgggaacatcattctgtgacaagtagagaatggagaagcactaaggaaaataaggagtgtccggaggtgggatgtggacagccagggtttcctttcttttcaagagcttactttggttaaaataagattgagtgggtagctatccctgtagagcctgggggcagatttattttggagggtataatattacttttttcccagataggctttttttttttttgaattaaagctatatagaagttaaggttattctatttggtgctgagtggggagccttatatgcatggtactggggtcaggattgacttgtatgtatgtgttatttaaactgttttggttgttttgggcttctggtgtgtatatgtttacataacattggttgttttggggtttctggtgtatatgtctttacacagtgttttagtagtctattgaaatatatcaatatcatttttacacaaaagaacatattttttttgaagagagtgaatgtcagatttctaaaagtatgtcaatcatgaatggatttaccatttagctacttacaatagaagcacccagatttttctgggagcctttgcttttttcaagagagtgatattccttttcagagaaacatttgtctgtgttgacaattttaaagaagtatgtaattttaaattatgaaactcaaatttagtttttaatagtaatttctgtgtttattctttctatctttaagagccaagttatagaatgacatgtgaccttgtactcttgactctatgtctggttgtggatttgaagtgttatttttgtgctttcctaaatgacttaagcacttatgactatatatttggatcagaataaatatggtagttggatatacttttgaaaagccaaccagatttttaacctggtaataccatagtactattcattcttatgattgtccagactcacagctttagaaaacagtctaagcttttattgacttccagacttgctggatttgttggtgttctctttttctctgtaaagtggatcagccgatgccatagatacactaatgctccaagctagagggctaccctgtagtgtgctcttgagtttcttttcccaccagttgagaagaatgcttctccagacctgactgtgttaattcccagacctgcgtgtgcccggtgtacttattatagtttaatacaatgattttaaacatgtgtgccaaaagaattgttgtttctatgaaaattcatttgaattctttggaaatcacctgataagaatgaatttccataaatgactgcagctaatttaggagtggctgagataagtaaaaaatttgggggatcataaaataaaagtatcctcactgatattatcagtcattcatgattggtgggttaagttgtgattatgtaaaactcgataatcgtactggctcaaagcagtaacccatgttcacactgtgtgtccgttgtggatcagatggggactctgctccatttgtccttaaccttactccagaacacagtctgatggggcagtaccttctggaacgttgctggtccctgtggcagaggggacgcctgctgcaaaggtcttattggctatatgcctgaattcagcaaggcgggacgtagagaggggtatggggcatttgtaaagggtaatgaggtctaccgcacttcactttccagggctctttagaacctcactgttctttaaataaattggacttggaggatgatgccttgggatggtttatagaagaaagaccattgagtacaacagtggacatatactcaaagaaaaggctccagcactataacaaaagattgacaataaatgtatatttgtagagcttcatttaaaatgacttgtttaggtatgtatcattttttatgacttccaaatttaactgacttaaaaaaaaataagccaaattgtcaatccttatgcatttggataagagaacctctactttagtcttaaacgctcctgtctctcttccacctctgtcaaattagtttcccaccttttatgatagactcatctgtgatttcccttggcacatctccttttcatttccattagcattatcctaattcttgttcctcaactactagattggggccccagatgaattccttgatatactgtcttgtatagggcctgtatgcagtgagaaaaaggcactctttggggcagacacaatcccacaggagctcaactttattttagtcaccttattctgccgccccccctcctccccagctggcccacttttatgcagtacacaaactgaacaactgcacagagcagtcctcctccctgcatttagtcgctttgccaacaaattcagactgcccatcctctgcttaagcctcctttaaatttgttgtctctattgtgctcaaaatcattttggtggctccctgtcatctgtatgtagtggctgacctcagttttatcttccatgggaccatcaccagtgactctgagccttagttgttgccatcttgatgtgtgacataagtaatgactgtagcacagatgcgctggttaggctatgtaatgcttctctctccccgcccacccattcccaccactctaacacctgtgagctccttaggtctgactcctagtctagccttggcttacctttcatcccagcttcattgttcatcaggctcctataccggccgtcctctgctaccattctgccaggtcaccgtcttctgaatatgttttttattcttgctttaaacttcttttctgcttaatcacatccaactcacctttcatggtcgagtttcacctcttcagctatccttctgtgattctcctgctgtatgatagtagctgtacctctaaacagaaatgttcatctctatattcctccttttgaggtgaatcgcctgccctatatgaacatattatactggttatcttactcttaagtattctttcctcagttagattgcacatgcatgagaagcagtagatgtgtctctcattctttcttctttcattgcctgctaagtactgtttgtataccagtagcatgggtcagagtgggaggttgtcaacagaagagtccagcatgtatccatgatggactctcgatcaactttatatgattaactcatataaaacagccctgtatggaagctgaggctgcctcttcctagccacaggatattgacctactttccccttcttatctgcttgcaaaatatttgttgtacttagtgtgttctccctgtcacaacgaatgtttgtctctctctttcatatgaactgaaggctaaagtgctagttaaatcagtggaaaaagcaatggagaagaaaagttggtaagcagttttaatttctaaaccagaggggccttataattttgtcatttaaaaagaactctagtttttctacccacctattgagagacagacgtaagggtagaaatgtaaattttaagttttgatgatttataatataataatgtattttgaaagccccttttttgataaactacttgtagaaggaagttaacttttcttaatcgggtttctacaaggtagttcactattgtatgttttatttcttaccaaaacttttcttgggaaaatttgttttattgctccatacgtggtcaaggtaattaactttaaaaatggattttcctatagctttacaggttattaacatgtgctgtattcaaggagaaaaaactgtgtgtgggggtgttgtcagtatgtctccttatataaatatatgaagtaactgctgtatcctgtagaatatttggaaattagcagaactattcaaatttagttaacatttataaatgtgaattttataaacaaaaatttcagtaaacattttatttgtgacttaaaaatgattagttatggcatgtcttataggttgatttgtttgtagtgtcttttgttcttcataaatacttcagaatgtatttaaggatatgtaagaattatggtgcctttgattttaaaaggaatgcttccaacattagaaaaaccagaaattgacctagaaaatgtttccaaattctaatataattgttgattttaatcagtgtaggtgaaataacccactgcagcagtttagctattttctttaaaaattatttctcaatttacattatcagtgtcttttttggaacatcttagctatttttgtttgatcaattctcaactaataaacattcatgaaatcctaatgtaaatgtataaatatctctgcctttgtttacatagtttattggactttattttagtggattactgcttgaggaagcttctgaatttttattattctaaaaaacttttttaaaccttgagtatgaaggcattaccaaagcttcactgttgagtgatgcatattttttcccctcctttacatgtagattacttaatttgtaatctttagacttttttttttttgctttcctaactaggtgaatttttaaaagtagccagttccattttgtagctaaccatgtattgtaaacacacagaaaacatgctcaaatgtgccttgatggcctaacttacctggttattctgtgcatctttctgtgctgtgtatggttgcactcttaatatattttattttggttatgagatcagaataaagagagctgctttcctttgcctctgagtaatgtcactgagagagattcttgtggtctggcatttgctggctttttggtttttaacattctctataaccagatctaggatgcatgctcatcccagaatgagcaaactcagtctttccagagttgagccttgtttttttttgttgaatcaacagcgttggaagctgggacaagatcctaggagatgatgtgttatacgctttgtgaggaaactgaggcttgaaggtggcagtgtgcccagtgtctcactgtgagctagctgcagagctgggcctgcaacttggatcttgtggatgttttttccagaaccactgcagtagtcgttgtaacctatgatctgttgcagaatgccaaagctgttgttttctggagggataattttcttccttaacctacaaacaagaatagtgcactaaattcagtacatttctctccattgtcactaaaagagcctgaacgatgggaaggcccctgtttttttttttttttttttaaagaaggccattctgccatagtgtatcccaggctgttttatgtgagtgtctttgttcagaaccaatccggagtggcctccaaaactaatgggtagaggaaaccctatgtgagtgcctaccaggtgcaaatcactgtatttttaattataatgaaggtgtaccttgagtgattgcatgatccgatcaggcataaagagaacagaggaatgaatctacaagtggtgtaagactttgttgaggatcttagcacatggaatgagattgagaccctctgattaataagctgattcatttggaagggaagttggttttcctctggtggctatattcaattcagtaatcaccagtctttcttggcgtctgtgcacccaccaggaacaaatcagagtcgggtgtgccagttatatttgaacagttttacgttcacttaggggttccggggtctcaggtttgccaatctaaacacattgacttcttggaatttttaaaatctgcctcgaaggaacgcattgaaaagtccgtgcgttataattagcatgttcccctgtacagctgagtttgtgtttctggatgtaacagcggtttatagtttttggctgcctcgtccctcaggaatttgtagccttttttcagacgttagctcattaattctccagtcattgtgagctgtatagcatgacgaccggttcccctacagctgggctgcatgctgcccattctggaccttctagggttgtggcaggtggggggtccatgttgagggggtggagagggaggcagggcatgactttcagacccagccttggagtggggtgtgtgctctctgaagttgacctgccctttggcagccattcctgccatgactctgtagagcttcctccgggaaatgactgtagggacagtggtgttggctgcatttcctccttagggtgttaaacctcatgtaagatcaactgcaaatgaggtaactcactaggttagttacctggacacacctgctaggagacaggacagaagagtaggtaagctcttcagggtgagaagaagaaaggggcattggagagggagaaattcatctaatgagtttgctctctcagtcaggctacataacagccctgtggaatagatattgtcatccctgagtttttagattagaaatttgaattccagagatgaattcctttggattccagcctgggtctgtggctccacagcctgtgccgtaccacaatggggtggatcgaaaggatccttggtggtaaactattgctgcaagccttctgtaatatagaagcaaaaactctttgaaaaatggtgcagtgttgtgaagagcttggtgatttaggaattagactgaagggtatatgtaatagaataggtgtgaaagaccattttcagacccgtcagaaaagcttcatcctcgccctggctcttctagaaaccagctggctccaccgccttcttttttaaaggaaggttttgcctgggattctaaggtctctctccttgctctttaattataaacaaaggcacttagaaattttgcccttacgtcacaagtgagagttggtaactggtaatccaaaaccttccatgttgttatagcagccgctgttatttttgactcaatttcttctaattagtctagatggtatattttgtcattctcactttacacagttgggaaaaaacttttttccctctcgtcagtttgcaaattgtaaggttctagatgctgtctttcagtccttaatcactggcctgtgcctgggattgagggtggttgattaagggtatctccttgttgatgacttttattgatgtaaggccagcttttctatactcagacagaaacagaccttgatcttggtggtgcctgtccctctctgcctatgcagagacaaaacctagggtgttaacccttagataaccagaatgttgaattaatagcccctcccactcacagctttttaaggttggagtcaggtatggcaaatgggcttccatttgcttttatccatttgtttgttttcacttcctgtttaaatctattggatttcttcattgcctggtaatttcatgtcctttgtattagccagaatttgaacacaagtcaacaacatactatatggaaattgcccagtagttgtgcctatttcttccataatccaagattttaacaaaagccctcctactagcattccattagacattttcagcagaaagctttagagaaaatgaggtgaggggtttctcaatatatagttggctttcacagtgaatttaaggattggaaaatgagagaattataattggtgaggtaaatgccatgaatagacacaccttatataaatatctttaagcaagtgtgtaggtaggaatgaaaatcagccatcacctaagtctttccacaaatgcatgtcggggcactcactttctccaatgctttagggagccctgcagggcaccccgtgtggttctgtgtggcccaccagccccatcacctttgagaataatgctgcttgagtaaattgtcctatagaatccagttttcacccagtttgcgtttttggttggtaaatactaaggaagtgtcttgtcctttggtttctaactttaatccttcatgaggacattcctggtgtgtcatcgaggctctctgatggtcctttgccagttatgacctggagtggaagggtagcgatgatggaaaccgtcctggacagaagaatgggctgtgcctgtctaatatgcatttatttattcattttctttctacacaccagagccctgtgtgtcagccacgctgttaggcatggggcttgtgcacattgagaacttaaacctcccttctccaggggaagagcagacaaacaaactcacaattgtgagggaagggaagtattttggcatattggtctgattgagctgctgtaacaagataccatggaccgggtggcttaaagaacagacatttatttctcacagttctggaggctgcggagtgggagatcaagttgttggtagattcagtttctggtgagggtcctcttcctggcttgcagatggctgcctttttgatgtgtcttcacactacagagaaagagcgaaccctggtttctttttttcttataaggacaccaatctcttcatgggggcctcaccctcctgactgcatctaaaccaaattactttccaaaggacccacctccaaatatcatcatactgggggctagggcttcaacataatagattttgggaggacgcaagcattcagtccgtaagatttggcttgctcacagcatgtctcctatgaggaatggttattgacactggtttaagttggggggtatttatgtctgacaagaggctcagtggaacctctcgagggcctacagctagaaccactctgggcagcaaaggcagctgttctgtctgcctgccatggtctgtcaccatgcttcattcttctcttcagataggcttcctctggaggagtctgggaaggttcacccgcatgatagctgttccctggatctctatgagctccatgctctgctgcccacagccacctgactgtggtgtctgtgtcctgctggcagatctttggaagctttgtttgggctggtgtatacccaccactcagttagctgtggtctggctgaaggtgctgtggcaggccttggcatctttgtgtgtgtgtaagtggggactgtgcaggggagagattggactaaggagaaaggctgtggaatcatgtgttctctgctaaggaatttcttttttaacttggtaaaatatacataacataaaatctaccattttaaccttttttaagtgtacagtttagtcacattaagtgcactcccactgctgtgccgccatcaccactatctctagagatttttcattatcccaaactaaaactgtagccgttaaatagcacctcctcattactctctcctcccagcccctggtaaccaccattctttttgtctctatgaatttgacttttctgtgtaccttatataagtgggatcgtatatttctactcttgggactggcttatttcacataacttagtgccctcaaggttcgttgatgtagcatgtatcaggatttccttcctttttaaggctgagtaatgttccattttgtgtatgtaccatattttgtttatccattcatccattgatggacacttgggttacttataccctttggctgttgtgaatgatgctgctatgaacatgggtgtaccaacatctgtttgagtgccttctttcacttcttttaggtatatacccagaggtggaatttctcggttacgtagggagtctgtgtttaatttgttggaggctctgctaaagaatcataatgctggctgaaaggcactggagagttattgaagggtttgaagcaggttatgcctaatcagattgtgatttgaaaaagtaacttgggtggtgtgggctggggaaaaggaaagggctggcaaggctgtggtggcgagacaaggcagagagaccccttagaaagctcttgaggggaagggatagaagtgagcttaatcaaggtgatacagtcagtgagacagattggatatgtgggaaggaaggaagagacagggagaagccaaggatgagaacctggatggatcaattgttattttgtggaatttagagggagtaagatttttcttgttttgttttttatattttggtgtgggatgattgatacaaattttggaaatgtgttgagctgttagacacagccaagtggtagagatgattggtaggcaggctgtcgataatatgggttgctaatttggggtaaaggagaaggtaagaataaaggagcagatggccatgcaatttggctgaatttaaaagtggtgggggcattatggatgcagcgccacaatttcagctcctgaggaatgatgtcacattcctaccttgagacaacatatcaaaatttacaaaacaaggaaaggtggccaattcattggttgtaaaaaggagctttcaaaaggattctaataagttcaaaaggatttagaccgaagcataaggatgttgaatttggcttatagtctttttgctcatctatattttctagtttttttctatagtgaacatgtattacttttaattattaaaaagttccttgaaaatttcaaaagtggcctattttcttgacttttctattggaccgtgagttcctagagggtgatgcagggagggggaggtaccacgatgttcactgtgttcttagcactttacaccatgccagcagcacaacaggcctcaatactgtaaaagctggttgaactgaattgaatggaaatttaatctaacccctctcagagagatgagattcggtgctattttaaaagatctaggaaggaaattccagtttttctgactcccttagctcattatattaggtactgaaccacatcctacagacttggctcctcttttgcctttgttttgccatcaggatttgctgagagttactgtgttcatgaaatcttgccacattggctccattttcttacctaaatatgtttctcatgctattcttaaaagcattagtgatcttgttgggagccaagtagctcaattctgtttcctgccctttgttgataatatgtttttggaggaatggatcaaagtggcttgaagccactgtcattgttttgccttctggtctgctgtgaccaaaccaaaggatggcagctgtgaggacgtgcattgttgtacgactcagttgtcaatcggaaatttgcatacttgttttccctttgtatatcactgaatggctaccatgtgcaagaggctgtgcactgtgctttcaggaaataaagatgaataaggcatgattcttgacaccaaagagctgattttctagaaaaggtgctgtcatgcatacatgaccactatacagggaggttaatgagtggaactggagtcagataaaacacacttgttactatgcgaagaagaatccctgtaggtgctgtctctggtgtatattgctaatgctgttatactgctaatgatgttataatatatgtgttttaaatgtcctcatttacaattaccaaagcaatagataactgctttcactaagttttcctgcaagtaactcttttggctttgttttaaaagttcctttaggctgggtgcagtggcttatgcctgcaatcccagcactttggaacttcaaggcagaaggatcatttgaaacctggagcttgagaccagcctgggcaacatagcaagatcttctttctatttaaatctaaaaaaaaaaaagaagttccttcaaatttaaaaccatgttagtgatttaatattcttattaatcattgcaacctcagctctgatttgtgaatattctttcaaattctacgataaaagtgtttcaacgtatacattgttcttatctgtggtactctgagaacttcaaattcaatggaggagcacgagataagatgaattttattttaacttatcatccatctcctcttagttattatttaattattaatttggaataactcctttgtagtaccattttgatattgaatagtggaattaccatgctggatgtgctgttttgtgtagccatctctgtgtgttggggggctatgttggtcttgacattcccaagtgcagatgatgttgacatatggtaggtggcttgcaatttaaggttagtgattgggtagactcattaagtttacgtggtaggtcacagatggccattttcagatgctataggttgtttatgctgcattctcttggattttgaggaacttttgaaatgctgctgtcagtattttaaacggtattttaactttgcaaaagataccagtaaatgaattagtgtatgttgaaatacaggtagtaattttggaagttcttgagatgagagtagataggggaaggaacaattgcaataatatattttgttcttcttggatggacagagagctgaaaagaactggcacagcctgtggagttgcctggcaccagttggcaggcttgtggctggcctaaattggtacccttagatagagagactgcttttctggactagtagcccaaactgaatatactgccaagtcccaaagttttgaaactagaacatggtctgataatttctttcctggccttggtactttgcagattgccatagttcttggtagtagaatccacctggggctagtaagaagcgtaagaagcagtagagtgaggtggcacctctcctgggctacatctgcatggcagaagtgcttatttctttctcaggccacagaggcagaggtggtgcttgggataggttacatctctatgtctcccacctccaggcagagtgagccctctgagcagtgccatatgttttcctctctggcctttcagacagtccagtttcacagcaagcttatctttttcttgtaaatccttaagaaataaccaacccatactctggcatcttgaatttttttcaaattctctaatgccacaggcataaaggtccaagtctcaagataccacgggccatggtttagtccactatttcactattaaatagcgaagatgatcatcttgtcagtccaagacagcaggtcctcatgcctgtgccttagatcagccagtttttgctttttggtgtattatttagaacacttcacttcctggtaccagtctcttactaggtaaaatgctttttgttgcaaataatagaaaatacaactcaaacagcttagacaataaagagaactaattggcttacatcactgaaaacttgagagatgggagcaagcttcaagtgcagtttgatccagaggtttgggatgtcatccaggctccagtactaataattctaggtaattttctttttctctttttttcttttgagacagggtctcactctgttgcccaagctggagtgcagtggtgcaatctcagctcactgcaacctccacttcctgggttcaagcaattctcctgcctcaacctcctcctgagtagctgggattacaggggtgtgccactaccgcctggctaatttttgtatttttagtagagacagggtttcaccatgttggccaggctgatctcaaactcctgacctcaaatgatccacttgcctcggcctcccaaagtgttgggattacaggcgtgagccaccgcgcctggccaattctaggtaattttcttgccctgtcctcctccatgtgtcgtcttcctcttcctaccaaccctcctcatgaaagtagagatggctgcagtagttccaagtgtcacgtctgcaagtcacgccatccagagacagagaacctttgtcctggtatttgaagccacagtctcaagctcagtcacgtgtccagccttgaatcagttacactggctagaagatgagaatatgttgattgacttagcctagatcacatgttcatttttggtacccagaacagcatggattccttgtgagggctcttggaagggaggaggtagatctataacagtatgtgtccaacaaaaagtatccccagtgctctacatacattctcatttaattctccctagagccccatgcgaattcttctaatggtttatggaaatgtggagttagcaagtgattctgaaacttgtgcccatggtaagcacatagctccttcagagaaaaaaacaaatggatccttttggtggagcaaatacatgaactaatttcattgacatgtcaaagtgaaccaaaccaaggctagagatggtggtcacaataccagaaaccaccataagaagatatggaaatacccccacaccgtttccttagtgtcctatttttaccttgagaatgaggtaggctgtcactggatcttctcccagtgtccctaaatgctaaaaagataaacaaaacaaagcaaaactgtttgcatgattcaatgactcttggtgtcaccttttcactgtggcttgctttattgtattttggtttgcaaaatacaatattcagaggtcttcactgtttaccagttacctgtaactcagcatttcttttgcactctattcctctttggattagaaagttgggatgaggtgtaaaaaattagatataaattccacattggaaaagatggtgaagcgggtaattacagagaaagattggctgcttaattattgttacctgcagggaagctgtgttgtctttctgcagctgttcctataaatagactatatacaggaatccaccccagggcagagttcctctttgcttaatttaaattgctggtttgaggtagttatttttgaaacccttctcaggttgacttcccccttaatccctaagccttcttccctcatctgccaaattatatgtaatgcatggcagctagagtgcttttggcattacatggagcctgagaacttgaactttgattcaaatgttaatttattgtggacaaatttattgtgacaaatggtcctctccctgtgcaagtccttctgtggactctggctctggcttcaccgtctctgtggctcctgctgcatttccatagcatggcacgtgcctcccaccctcatcagttttgttctgaaacagagcccagccaacttcaaaatatacagagcagttctttgggccgacgttgttgagttttagtggtatctgggacttttctttctttcttttctttttttttgagacagagtctcactctgttgcccaggctggattacagtggcgcaatctcggctcactgcaagctctgcctcccaggttcaagcagttcgctgcctcagcctcctgagtagctgggattacaggcactgccaccatgcccggctaatttttgtatttttagtagagatggggtttcaccatcttggccaggctggtcttgaactcctgacctcatgatccacctgcctcagcctcccaaagtgctgggattacaggcatgagccaccgcacctggcctatctgggactttttgttccaggtgtatttggcttaaaattataaaaaacatacagtaacaaaaaagttactctattgtttttctttttagtgttaaatacttccttattttatttatgggagaacctctcataaattcatcttagtctctcttttttggcttttcatagccaaaaacttgttttaataggatcagtaaaaaaggatatgtttgtgggttcatataaattgctagtaattaataataatgaatttcttaattactagcccttcctagttctctttaaaccagaccaactaaatgtagtttctgctgcttctacaagacctactggatgttctagactagaagtgggggacatttgtttaagttgctgagatttcagtaaggacaccaacctttataagacatagtgtgccgaagtgactccttaataggaagaatcaaatgtcctttccactcattatcagtggcaggtatatatgtaagtatttattagtattctgaagtgtgattgagtatcagcacactgaagttatataaaactggcttctacattagaaacatttagagagaatggcccagatgaatttagttttaccattttaccatttagttctggtaatattaggaaaaataatacagacacatgtgtgcatacacacatatcccacacactcctatgctcagaaatttgaaagatttttagtactcttgacagtgatcagattggaagccttggggattaccattctgctgttgggtggcaccatgcacattagtagcagggtagaatgctgcctttgtagcgtgcctctgtttccacttggtagattttcacattgaaccaaagggaaactgtagtatttctggtctgtttactgcgtgttaatttgattctgctgttatagtggcatgtctgttggtacaagaattaaaaacgtagaggccacttttatcaggttatgttatactggtagcctgtgatttacaagtgggttgtgttcttttctttatatgtcagtattgattgtctggaatgaaatttcctcccatagatgccatgttagacgtggtaattgagttctttcacatcaaatgcaaaacatttttaagtaaccatagcaagtttcataatctctgagcttcaattttcttatcttaaagtgggaatgacaatacctacctcatagagttattgtgagggttcaattaatgtaaagttcttggtatagtgtctgatatgtggcaagtaaacaacaaatgttagcagcatcattttttatcatcttcgaggaagcaggttcatatagtctgacattggtacacaagggctgagggaaagtaggggtgggttaggttttttttcctccccctggagttttgcgactctctgctgaggagaagaccatggctttctagtggctttttctgtaggtggacttcaccagggaggatggactgggaaggaggttcatttgtggcagcaggttggcaaatggggcagctgcagccaagtcagaggctcctgatgtggttcatagggaggagaggttatgacattttttaaggctagtgagagtcatttggagctaccagtgttggatttctgcagtagtgccaagaacctatttgaaattattttgctcgtttaaattgacccctttccctctcttctgcagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacgtaagtacacacgaaggtcatctgtaatgtttagactttgtattttgtgccagagagctgtcttttcttcctcagactcttctttcttttttctctctgtttgagtccagcagtatttgctttataccctcagaaagagttgagtttttactgatttagcccatgagtaatgtgggttagacaagtcagtctgctttctgtgatcaactgtgtgcaagtattgtagtgggtgttgggggcattctaaagcaagcagaatactgccctctgaggaatttagaaggaattttgaaatccataggcatcttcttggataccttcataagattaacaaagtctaatcagggagaagctactcattgaaatgcaaggcagtaaactgtcaaaaaagacatgaactttctcgacatttgtagttagtagggacaggagcagattatcagataaaaatatgtaattggtccctgaagatttggctatagtcatgtcctactgtacaaaagtctaatgccatatacataaacagaagcataaatatgtatatgctataataggagaaaatttcctgttgtaaaaagtctttataaaggatttcacagggtcaagttctctaaatattttaaaaacatgaataaaaaatacatttatatgcagcttttctggagtttgcataaagcatctgcagaagtaaaggtgtactgttaactaaaccaaagaaatgaggcattgattccctgtacctgcagctgagaaggaaacagaatgttttggatgggagtagttttagtggactctgcctcacttcctgagttctctttcctcctttttaaaatgtgcatctgtgcatggagaagaactggattattgggcatgcttaatatttttctgtttatcattctagggaggaagtataaataaataaaagagataatacagtgatacaagtaggatcagttataacttttgtggaactaatatattttgtaaaattatatgcaaattatgagctatattattttatatcatagatagctctcttttctagatagccaactctctttatctgttggagctgcgataccaaaataccataaactaggtggcttataaacaacagaaatttgtttctcaacagttctagagtctgggaagtccacggtgaaggggctggcatattcagtgtctgatgaggacctgctttctggctcacagatggcgccttctaactgtgtcctcacatggtggaagaggaatactccttcataagggcactaatcccattcatgagagctctgtccttatgacctagtcacctctcaaagccccacctcctagaaccatcacattggtgactagctttcaatatataaactttagggagatagaaacattgagaccacagcaccaaacatgtttcaaggatgattttgagtaatgtatttatgagatagtagtcatcctctaggaattgaccttttcattcttctcactttgtattggtggaggtgggggaaggttgatggtaacaagaggcctgtgaatactgcttttggagtcttaattggataactggatactaaactgaaatgtgtttacagttcagagatgcgattatttaaagtgctgatccaaatggaaaaggtataaaacactgctgcagagcagggggtggcattgtttggcttggcagtactgcctggtgtcaccttccctccaagcgtagcagttctgctttcaggtgggaaagctgagggttctgcagctttaattgaaagtatgctctgatatcaaataaaagacagactttaaacattggtctttgagatggagataggcagaatcaattatattgtaactaacgttaccgatcatttttctttttggctctgagaagcacaattcacttttaaatgaattgaaaataagatggagagtagaacattacgtgcattcaaatacctgatttgttgtggccactaaaaataaaacaatcacctttttaacaaaatgccaagtgttaacattcatgagtctttagcagacgaaatgtctggatttcagctctatgtaattttattttctaaacgtcctttgtgtttataaaacaaaagcagaaaattgatttcagcttccagatattcatatcaattaatgtttttcatgataattcagggctactgtttccatgagatgtgtgcctttgttttgtaacttcaaacacctcatgttggagggctgggcattctctattataagtgaaacaagagattgtaaagtaatgcgtatagtatgatccttttgtaaaagatgtgtatgggggtttacgaatatgtacatatgtttgtatatatttgtatgtacagagagacaggtatgttaccttcaggtaccatagtggggtgggttgggatagggcatggggacagggaaggttactcttttagacctctgtattgtaggacttaagtcaatcatatattgcttttgtaattaaaaaaaagctgcatgataaatttgattaccacactctccagccccacatgccatgtattcttccctggtgaaatctatttctggctcttatcctgataatactcctgctttgcctttgttcatgggttgctgcaaagttgtctagcttgatgcccaaggctaagttaatatgacatggaacattttactgtcttctgcttcactctgtttttcaattctttccaagaaaatgaagatgcagttaaaaaaaaacatcttttaaggtcttatagcttcattttatattataaaaatgggtgactctctagggatgatccatcatgtgagcatattgaacagtaatttgtatgtttagagctatgtctgataagggggccagtgaacaggaagacccttgccccagacttttgaactctggatctggatacacccatagcctcagcaatctcctatgtgaaccagctctaaatcggggggttcagttctaacatcctgccatccatctcctcttctcctccctcccccaacatatttagaaatgaaaaatagtctgtatcttcccagagctctcgtgagggattgctttgcccctgggtatgagttacgactctctagaacattcacaacccctagtgatcctctggatctgtagcagctgacgctggaagcagactcccttgtcatcctgtcgtactaaacctgaagctctggatagagcaaggcattctggagttagttggaaatgtcaggtagtgttagaatgtgctttttgcaagtagccgtcacacccacatttattcacctgaaaatccagaagtcattctgctttcacaattggtttgatttagtggctcagtggtatcactaaggactttgtgacttactgtctgctttgccttccttggctgtttctttgttctgaggcttcatagtagcaaaccagctgcagcattccaggctttgcattcccgcatcgcgctggctagaagaagaggcagtgctgcttctcttctggcattccaagtcagagtcctgagatttaccttggttaggctgccggagtcacactcccttctcaaaccattgactgtggcccggagatggcatgacctgagcgacttaagaaagtgatgtttaagattggagttgaaccagatttttccaaagtagataggctgtatgtgagggggtgggttcccaaccaaatatatctattcacacactaagaagagaaaaggggcagtggatgccgaggagcccactcactgtgaactcctcaccggtttggtagggagttctgtaatgaagtggcttttttgatgttgatgtcatgttaaaggatgtgtccatgggaagaattggtcacttgagttctaggcttcaagtgcgcccaatggcttgcttctcagacttttctgctggtgaacttctaatggcagagaagagtaaacagcttcccccaggaactctggagcatggtcgaagtcctgcttcagggaaattttgccgaaatgtttactttcaaatgtaattcaaagctttatactgttctctagtgcagatgggttgttttgaactaatataccccttgtaaccctttgagtaagttgcatgctccagaaatatctgttcttcactttgaggtgggttgacacacttgtttaaatagcactggattggttcatagccatctgtggcctggttgagtctctaaatctgggacagtggcagatattgacgtggtcttcgcagttagggcttgggctattcagttggagatggaggaggatcaggtgagatgagatgggggaaatgctgaagtgatgctgcaacacacagggtcagagactctatttgctttttattcctccatcttggcggagtgtggttcaagctgggcccagctgcaggacatgctgtttggtctgacaggctccgtggggtcaatggctgggaaatgctggtcgtgacgttcccgagcactgcttttctgtttgctttctgtcctttgtcagaccttcttccggcctcccctccccggcccccaggccagatggatggtagcaggatttcatgtggacttttattgtgatgtaggagatggcagagctgagatccggccagacatgttctgtttttagggtgactggtcaggactgtggttctattcaggaacaggaaagctacaatttaggcaagaacaaggcccagtacaaatttggaaaccagagaaccaaggtgtctgttctctgacgagaagtatatttggtgctgaccagtaaatttagtttgttttctatctgaattgtaagattggggatcatctagatataggggcctgagttagtctaatttttagatcttatgttaaactaattgtagttgtaggagtgactactttaaaagtataggaaaagttgtcttaagttatagaagttaatactagaattaggattcccaggatgagattagatacttttatgaaagatactcaagatatagtaccatatatttgatttaaaatattgtaaagttaatgaaaacaatactgattaacacatttatttgaagtttcaaaaccacttttcatttatacacatgaaaatcccacctcatgggtataatctctgttcctgggaatttggcgtagatggagtagtagttttctcttgctacaaaataaagtgcacagacttagcaacttagaataacatacgtatattatcttgctattcctggggtcaggagttggggcctggcttagctgagtcctctattcaggattttcccagctgtagtcaaggtttcagcagggctgcaatcttatctgaggcttgaaccttttgcaggctcatggtggtggtggtggagagcagggctggagttcagacaaccacctgagtgttattcctgttactcagccctgttctccaagttttattctttataaaattttcctttaaaggttttttaaattacaaaataacaaatgcttttgggaaaaaaaaatttcaaatagtacagccagacatatcataaaaatgtagttttctcccttcagtaccacaggcccattcccagcgtgaacagtaattaatagaatgatgtgtaatcttcaagattatgttgggtgaaaaaactaattttcttgttctagagttggaagtaggaggaggttctcttttatctagacgggcagacctttacccaggtaatccagacccaacagagtttgcatggaacaagagcaatctttaatgccacctccaatcccacttagatgaagtagggaaggaaggaggagggatcccagccctgttaacatgaaatgcctagacttggttgtatgtgagtggtttaccatcagtagtgctcagcttactctgatcgctgcaaaggtagaccattaaggtaaacattgagaacaaattgtgtgtgccttccagagtgtagctttggtgtttgaaacggagacacagctttagaagcctagataaagctgttgaaaaacagcaaatcatgagggtgaagggaaatgtcatgtctaatttctgagcaccatctatctcttggacagtcatttttgctaataacttgccagcttcaacccatgcaaactttcctacagcctttggtgattggaaaatttcttcctcttagaattttcaaagttgacacatatttgttgcttaccaaacttagagagttttttcatcatggaggcactgtatagggcttgaaatatttgtataatacttacagtgcattaacttaaatattctggttgaagctaaacctaaggtttgatttgaagaaattaaggcctgacatcagatcttttggaagcagtatggtagcactaagaagcaaaaacttgacgtctagtcctggccctgccacttagtgagacctgggacaagttaactccttggagactgttttcttattggttggtaaaatgataaatgataacaaaggacatttttgatttccttattggtaccagctgctgttctaagcactttacatgtattattcatttaattttcactagagtcctatgtactataggtttttaaattatcttcattttacatatgaagaaaccgaggctcataaaggctaagtaactgtccacgatcacacagcaagtaggtgatggagctgaaactcacacccaggaagttcagctgcagagtccatgctcttaatgatagtcctgctgactttccatggttgctgtgagcatcaaaggatactactgatacaaaagccctttcaattctcaaaataattgggtatgatattgaagaatgtgtaggtttggaatgaggcaatctgaaaatgacctggacaaataatcaaaatgataatcagtattcctgccatgtgttgagctgctcagcagtgcagtgacatgaaccagcgtgacatagagcaaggacattcatttctaaagtcataggtgatcattacatggtgctctcaattcaaaggaaaagtgatagcagccatgacaatgattttttccccactgtggaaggtgggagaagatactgggaggaaagtatatttcatcatgttcacaggatgacaggtaactgacagctgcacatggctcttcacctttatgagcacgagagaggaggaagaggaagcagttcggcacaggggacacgtggccagttaattctgtggccagttcaactgtcccctctacacatgcatctgtgtctgttgtatatccatagtgcagaaaaattttaataatcctaatttctaaagagaggctattttgttgttcaaattctgctttggaaggagtggagggtgaaatgacatggcatactgggaaaggtgtgagcttttggctgacagacctgtttgaaccttggtgacttacagtcactgtgaccactgtaaggaatagaggttctctcacccataaaatggtcatcgtggtacttatcttgttgagttgtggtggggattaagggacatcttagtccagtgcctatcacatgatgaaagtggagtgcatggtaggtgccccgactgtctgaaaaacttggaaatccagaatcactttttttttgaggtttcagacattgatgttttctttttttcgagacagagtctagctctgtcccccaggctggagtacagtggcaccatcttggttcattacaacctctgcctcctgggttcaaacggttcttctgcctcagcctcctgagtagcttggattacaggcacatgctgccacacctggctaattttttgtacttttagtacaaacagcgtttcaccattttggccaggctggtcttgaactcctggcctcaagtgatccaccagcctcggcctccgaaagtgctgggattataggtgtaagccaccaagcctagccaagaccctggtattttcattagttagattctttctcttctccccttccctgcctacttctttccctctttctgtattcctttcatagcagttcctgtgtttcatagcagattcatttttgttacattactactttcaattaaccacagaaatattattttaaagacatattgtaaatattatccctttaatacaggaccacaggaccatgctgttaagagagttttattaagtctggagaatggtatatatttggaaaatacttgtctcgtgacacagtttgtctcaacgaagatatggcagtattgtattatcctgctctaaaataaagacgcctgaggtgatatttttagccagtatttcagcgtggcgttgaactcatatatagttctttaattcatagtctgaaatgactggctgcagcccaggaacaagagtataatatgatggtagtgtaggcacgtcttggactaggcagcagagactgtgcctgacaaacttgcggccaccgtcggcagccacggtttgcgggacgtcctggcctctgaatgagctcctgacccaaggccagtgatttaaggcacaacttagataaaaagatgagcaaggctagattctttcctcaaactttgaattgagaaatactgaaaaaataaaatatcaatgggatcaagatgctgagggtgatgaagtcgagaggagtacatgataggccacaggcaaacagaacctatgaataagaggctttgaagtggacagccgatggagtagaaagtgagggaaccagcttgcagcaggcatgaaagaaacaaggggagaagcagagacatgggcaggggcgaggctcattgataccagaactggagaggaaatcttcacaaacttgggttgtgttggttcatgagccgtcctggacccatagtcaccctcaggtcccagatttgttatagcctgggatagttgtcaggggttcctaggtgagttcattaatacaggaaatggacctggatgccaagcagctgaaagagcctgaccaagtcactgttctccgtcctattgtcatagtctttgatgcagagctttgggatgaaactctgcttctgccactgatttagaaaccttgggcaagttatttaaaaccttctaatgtttccagttctattcccctgtaaaattaggctattagcatcaattttatatgtctattgcatatgcatcacaaatatgtttctgagactggcgacatgagatgcatacactgaattacatttttaaaaaatataaggcccagatagacacctaagtctgttattcaccttatacttgtaatttttacttaggcattttgcacagttttgaactatgtctaaaaaacaaccaaagtgtttggtagaccatactgtgtctttaaaaaaaaaaaaaagaccgaggccctctgcaaggaaatttgggaaatcttacagatgtctaattaaaaacaccgtggcatatgacatcttaatatcttgtgatcaaattcccagggtctcagacccaggaaggaagtagattcctcatattggagtgaatagcatgttgtcatttttgaggattcccactggtctgtcttgtatagtcattttcttagtatcctagacttttaatattagttttattaagacataccttatgtgcttatctgaaaattcatcaatttcctgtatacaaagaccattttgggttgggtgccgtggctaatgcctataatcccagcactttgggagtctgaggcgggccgattgctttagtcgaggagttcgagaccagcctgggcaacatgatgaaaccccgtctctaccaaaaatacaaaacttagccaggattggtggcatgtacctgtagtcccaggtattcaggaggctgaggtgggaggatggcttgaacctgggatcggggctgcagtgagccaggatcgcaccactgcactccaacctgggtgacagagctagaccctgtctcaaaacacaaaacaaaacaaaacagaccattttgtaaaagtttttaagacgctggtgtggtaggactcattaatgaatttagccatggtattaacatattttatgtagactttcaagtcctgatttggctctttacagtagccaatagattccagtagagcccagctaaatttatataattataataggtaatatttatggaatgcttgctgtgggtcaggtgctgtgtttgatgttttgacacacaacctcatttaatcctcagaattagatgagggaggagctagtatgcttcttgtaaagatgaggaaactcaggccaggcgcggtggctcacgcctgcaatcccagcaagttgagaggccgaggtaggcggatcacccgaggtcaggaattcaagactagcctggccaacatggtgaatccacctctctactaaaaatacaaaaaaattagcttggcgtggtggcgggcacctgtaatcccagctactcgggaggctgaggcaggagaattgcttgaaccagggaggtggaggttgcagtgagccaagatcgcgccattgtactccagcctgggcaacaagagtgaaactccgtctcaaaaaaaaaaaaggtgaggaaactgggatgtggaaaagttaaataatgtgcccacgttcacacaaaactagagaattttgccagctaatttggagccaagacttacacaatatttcaaatacattgaagaattattattatgaaatgacataggtagaatctgagtaaagagcttaaatactatacttaggtcagaatgatgtgggttcaaatcccatcagtttcatcatctaagcccctcatcccccactgacttttcacttcaaaactgcttttggactcaagctcagactgcttacgtgaagttcaaaggctctctacagtttgatctcagtcttttttttttttttttcctggctttagcaagaattttttattccagtcgtaactactcaggggatgtctttgttttagggaagctgttccattctctgtctttggtatgtgcttgggtaggcctttgtgcctctgtctgtgttttaatctgtattctagcatgtgtcagaattcccttcctttttaaggctgaacagtgttccattgtacgtatctacattttatttatctattcatctgtcgctggacacttgggtgacttcctcctcttgggtatagtgaataatgctgctataaacatgggtgtgcagatatctgtttgagtccctggcaaattgtacttaaaaaaatatattttgaagaagatagcttagcttaaaaaaaaaaaaaagaagaaagaaaggtggtggctgggcggcattcagctatcacctgaaacctaacgtcttatgtcactctttggggggaactttgtccaaatcatgcccatctttttagaccgctcaagctgtctgtcttctctggagctttctcggacctctgcagttcatagtgacctttctttatataaccctggagcactcattagacagtaaaataatcagactaatggctcatttagccaggaatcacatcctgtttcatctgttttaatgtctagagaagttaactcttaaattttatgtttctctatctaaaagactcacttcctaagctatattataaacttcccaggcacacagacactgggagctttgtatttttcctaccatgcccagcatgatgttttgcataaagttagcccttaataaatttgttgcttgcatgtaaaatggtttgtagcctaaaatcactctatcagtcagtgcgattgtgcagccttgtgatgggttattcttacctgaatcctggcccatcctggatttgaactatagattggtgcaaaagcaattgtgatttttgcgttggaagtaatggcaaaaactgcaattacttttgcaccagcccaatactttagaggcaaaagtaacatgacttggagacccttggagatgcagacgactcctataccttctctgatatttctttgatgttattttagactaattcgtattaagatatttaaataaatattgccttttacatcaccacattcctgatttatttctctgaagttaaagaatgattacgattgaatcttttctggtgagagcaaacattttccctataactagaagatcttttccttttctgttttgtttattcctggcggtagaaggatttctcaggtggtaaaatgggaggcttttgcctaacagagtagcgctttattacacaaaggttgaagatgctttatatggcattgtgcaacacaagtttcctccgttcttcttgcgtgctttttaccaaagcttcccaggcctaacagacggcatggattgtatgctctaatgaaaagagaacagattcttgtctccttgtcttgatttcacttctgctagctaatgtggtcgtatcacttaacttctttgtgctcctttgttatggacattaagatagagaatttgtatctatctcttggggatttgggagtagtttagtagaaaggtgtgtatgtgtatattctatgccagctgttcaataggttgaggatgagtttttaaggaactccagagacatgtaaacaaataactgaaattcatcctgaagaaaataaggaagcaggtaggtagacagattggatgcctagttagagcccagcaaacagaggctttaaaaatagattttgagagaattcgatatttcaaaaaaagcatcaaagtacatgatggcaaaaataggtcattatgggattttcttacatgtattttatggtgtagttatacattttaatatcatatgagaaactgaaatgtaaaccttcaggatttagggcttctaaagatctctatcttaccctgggaagaattatgatataaaagatattaaaactattctgactttttagaagaagttttatatacagacttggaaatattctgactgttctgtgtatgtgtgctaatgtttcatttatctgcctttgcgaaggaatgttacacattattgagacttacataatattaaagctgtgctaaaatatttaactttttggttagatatcattctaaaatgtattgcatatatccttgtcatcaaaaacagaatacactgattttggctgttgattattaccctacgttcccaattagtgccataataaagcagtcagggccggctaagccatggggctcttgggtcttactataaatatttttatactttgataattatcttcatcacttcttacttattttctttctttctttgtccctccctactcttccttttctattagtggccattgtttctctgcttgcagagggagtcttaacctggtatatcacatgtatgcagacttcaatgtgcatgtgtgtttttccaaggagaagagtcattgcttccgctggtgtctcaaagggatcaacaattgaagaaaggttaaggagtgctgtgtagcacaattttttaaactgcaagtttcatatcattaattgctcatgaaaatcatttagtgggttagggccaacagtttttaaacattttgtaaaaaatattagaatcgaacaaaaaatatcaatgtatcacatatagtaaagggtacttttggttttgtgaagtttttatcttgtatatgtgtgtgcacataaatagacatacatacacatacctggttgtgatgaaaattttatttcttatatatgagttgtaatcaaacatttcaaattcacagctatagtacggccctttttgcctcttccaatatacagatgttgctgcagtttttctgtagtctattgagactatgccaagtttattagaaatgtggctaaaatgagagtgaggctagaaggacttttcttttgtttcagaactagttccataggagtatttaaaggggaaggtgaaatagaagataagccaacagcagcactagcaggttgttgcaattgagagtaaaacctggtcctgtgagtctggaagggaagggctacagacattggttttcaaccctggttccacattagtttatgttgggtctctttcaaaaaagtactgacccctggccgttccctacatcattgaagtagaatctctgaggattggagttctgaaagaactttcttatagaataaaacacgtggcctttaggttatattttgactactcaaaggcttttcgtttggcttctgaacagtggtctggggagtggaggtggctagattgaatgtcctccagaaaagacctctgttttcatggtaattatgctaagaacactcaagtattatttgattatttacaagacatctgttttggaatgctagagatacttgaaatctaggaaggtcgagatggttttgacttaagaatgtttgtgcattcttgattcagtgtctgcccttgagaaatgaaatataaccttgctatctgtatgtgccaattatagaaaggtagagcttgttttcttctccctcttccctttttcttctctttcattcttgtttgcttctcttccctcccacatctctttcctttcttttcccttcctgggtgtcagaggctggcccactgagcagaggcatagagggagctttccattgtcatattagtggtggcatggacctgagggcttaggggagctgaggttcagaaacgtggaggggtgagcctagaaatgcctgggctggttacttcataatgagttggtttaccatcctttttagagcgtgatgcaataagaaaataccaactgtaaatagtatgcagttgtttatttaaaaaatgacatctgattcacaagtccaaatgttaatcaatgtaaaaatgaactgtctggtcactatcattctgatccttgaaaaggagatttaatctggtgctgtagtcacctgaatgtagaattggtagctacctaaaactagagtagaaatgttaaaccccacccagcaatcagctgctatcaggaatgtctttctgtgtctcagaggaagcagagttgtgactgtgaacatttgagttattctactggcccatgtaggaatatttaaacctttggctaatgcacatagaactttgaggaagaaatccataaacagaaagggcaggtataggatgaacctgttaggagttcaaggttagaagataaagaggatatctgaactgtataaagtggaatggagagagaaagcatagtttcttttagtgtttgcttatttaggtggataaaacttgtcctgcttggcaccatttttagtttcttgagtcatgtaggtattgatgaaaagagtcaaactctaaaatatttaaagagatttattctatgccaaatatgagtgagcatagcccataacacagccctccttgggagatcctgagaacatgtgcccaagatgattgggacattttaggcagacatgagacttcaacctagagaggtagaacagctcgaagcagtgaggcttccaggttataggtagatttaaaatttttctaactggcaattggttaaaagagttaccaatagaaaggaatgtgtggattgctataagaggttgtgaagaccaaagttttatcacacagataaaacctccagatacccggcttcagagacaatagattgtaaatgtttcttatcagacttaaggtctgagtcgatgttaatgctggagaggtataatgaggcatgttcgacccccacttcccatcatggcctgaaccaatctttcaggttaaattttagagtaccttggcctaggaggaagtccattctgatggttgaggggccttaggattttatttttggtttacataggtgtatcagttactgttgccatgtaacaaactacctctcagaaattaaaggcttacaccaacagccaattatttgctcacgattctctgggatagcaagttagcctgagtttagcattgtatattttctgctagtctcacctggaatcactcatgtggccttaggcatctggtgtccttactggggctggatggtttaagatggcctcactcatgtctaatagttagtgtagcaggctgtaggtcaggataccttagctctccacaggacctctctgacaggctagctcaagctcattcacatcatggcttccagccacagtcataaaaaaggagacacatcctaatacacaaatgcttctcaggcttctacttgtgtctcatttgctaacttccctttggttaaatcaagtcacagggagaaattccaattgaaggagtggagaaaaaaactctatctttaaagtaacaaagtcacatttcaaatgggaagtgcatgcagggatggaaagaattgttctggctgtttttacagtctaccagagtcaaacgacatttagggatttgttaaatggtaatgttaccggaaaggagtcccaatccagaccacaagagagggttcttggatctcacgcaagaaagaatttggggtgagtttatatggtaaagtgaaagtaagtttatttaaaaagtaaaggaataaagaatggctactccatatgcagatccatttttatggttatttcttgattatatgctcaataaggagtggattattcatgcctccccttttcagatcatatagggtaccttcctgatgttgccatggcatttgtaaactgtcatggcactggtgggagtgtagcactgaggattaccagaagtgttctcatcaccatcttggttttggtggatttgagttggtttctttactgcaacctgttttatcagcatcgtctttatgacctgtatctcatgctgacctcctacctcatcctgtgatgtagaatgcataatcatctgggaatgcagctcagtaggtctcagccttattttacccagcctctattcaagatggggttgctctggttcaaacacctctaacagtaacacatggcatataggctgattaaaatactaagcactgagtatagtatatttgatcttatatttcaatgcaagaataattagatgtgtttcagtggcttgtaccctccaattagtgatgaacataccccatgtgatttggtcatttagttaacaaatatttattgtacatcatggtgggccagacactgttctaggtgatagagatgcagctgggggaaaacaaacacacataattcagtatgtgtaacagtcacaaggaacaaagagaaacttacaacttattactgtggcttttgattttgaatttgaggcaacagagtttgttccctgtgcaagaatgccacagaggcagatttttatcaagaatttagccactgtgaagtttggttttaaagagcaactcagtaagtggtttttctgctaacagcaaatcaatatattttagaaactattgtattcaagaaaaagggagaaggattcaaatagtacttttctacttaaagaaggttgatttttttaaccaatagatgttaaagaaataaccaatggctatattttcatatttaccaaggctactaattctaatgtattagctggaagctattcagacaagtattcagtgtcaggcgtctcccatctgatgtttgcttgtgacattgtccttgggagacatctcccatctcctaggtgggttgcagtgtgaggacaaccagaaaaccttgagaaagttttgtcattgtttgtgaggccagattaattgggtcctagtgatagaatgttagaaataaatgtgaaaaattgcatgggaactgagagttttcttttacaacagcaatcttgtccacccttgacaagataatatttgtccacctttgacaagatagtattcttacaggatgaaagtgtgtttatatatatatataacctgttcagttttcctagttgggagaaagtccttcataattaatatcattgtgacccctgtaaaaagaaaaaaaaaagtcagcagaacatttctacgttccttcattttctattctgtttaattttctagaaatatctgacagtctttttgaatcccagtggtggtaatactggaaaaacttgttgctctaaaaatggtaccttttgtgggatgacattggaaaggtgggaagttggagatctttttttccccttgtttctttctttcctttatgaacctttttctttttaaaagttatatcgctcatcactttatcacttagtttatcactttaccacttttgttggcaccttttttccccctcctgtcttttatgatgttgaaactgaaggggaaaatggagctgccaagataagttacagttaagtgacgtttgcttgtggcattgtccttggcattgcacagaaggaactaaaccagcaccactggtgctgccaggaatttagggtcgaagtagacaggaagagaaattgtgttctggtttaaagttcagtgagaaaagtttagtacatgctaaaatatagcactgatccctcagaaagtgcatttaaattttacattaaatgtaaatttgacattaaatttaaatgttgacattaaatgtactttctggaaagtacctttaaatttgacactaaaactctgatattatgttagatataatgagattatgtggtttgaatgtccaagagatacctgtagctctgatactgaattgaacgtgatctgagcccattgtggaaagattgacagacttgcagagggccagtgccaaagggaaggccctatgaggtgtgggtagggaagaggggaacactgggatactgttgactaaaaaggtggaaaaagatgagagaagaaggggaactatagctctatctagaatcagggagagcatggctcttgcttacagttagcagtagtttgtgacaaaatttgtggaaaatatgacagggctttggagaactcttaccgagaaccgtaaattagttcagagatatactttgaaaggattttaaatatataaatgtatgctttccatttatcaacaaactaaatagacattgttgaccatctgtcttcagagatgcaaagcattcttaaaatgtatacaatgaatggtgaagcagaactagtgttgattttaaaaggttgaaaccatacaacactaaagcttaagacgttaaaatacattttgtgtactaactaatgggcatgttttgttctttcttttgcagacatacattggaagtgtggttatatctgttaacccataccggtctttacccatttattcaccagagaaagtggaagaatacaggaacagaaatttttatgaactgagccctcacatgtaagtactgtactaaagcattaagtttctcttttactccagagatgtgtagttgacagatgtgtgcagctgtctcctttgaatttcagaataatgtttttgtcagttttttttaaaaagtttgataaaagtatgaagactttaattgttattattttaaattaaaaaaaggcagaatacttcatttgacgtcagacttttctgaaatatttggattcaggatgtaaaatattttctgttcaaaattctttgcaagtagcagctgctgctaattatttttgcaaataaaacaggaatgtgcattgtttattattataaagagcctaagcagctttttcatagtgttgttgggccaagaaaaatcctgagtgttgggttgtgtgatggtgtttgggtaaaaggaccaaacaataccttcagtttgtaatttttgcagacaatgttcaccagatgcgtgggataggccagtgatttcacttactctggaaagtcacttgtttgatttttctgaagaaggtcacttgttagtgtaaataattccttcacagtacctgtagattctgtttgtctgctcctttagagttcttcgttgacgtgcttaagagatgccgaaatgatttggccactttataccactacaattttgttttctagtctgaatgactgaaacataacactggaaaagtttgcctggatttggtagatccgtggtagaaccgggttattcaaccctagaacttttattcctccaaataaaaatatctgaaaaagaaagttggagagagaatacccagaaattatcacaaacaataccttaaactttttatttctcaaaaaacttttttatttattcttatgttacatttactgattcaagacaaatatgttcaccatttacattctcatgtccactactgagtttaaaggaaagagaaatatgctaagttgggccaagtcatgtaatgagttgagagcctcagacttctccgcttgttgcttaggcagaaacatttcctgcctcctctcctgtgggcatgcaagcatttttaccagaattcacgtacttatgattgtcagttgctgcaaggggcccacggtgtcttgcagacgggagttggttgatgcagcataacatcttttatgcaataaactgttgaatgcagatttagaatatttgtgaactgctgctgaacgtgggctgggaataacgtatgcaaaagtgccttggaaggtgtcaagcattctacaaagttatgttgttcgttattaccaccattgctattactttttcgcagtagcatcatcctctctctctcaaaacagatgatatgctgaaaacaaccccaaattgtcatgaaatgcacataaatacatgtgcatgtagatattgatgaggaaatgttcagtaaatgtcttggttgcggaaaagatttattggtcattggcatattggtagcggggcatttgaaaatggttaagctggcaatttgggtcactttagagttgagacattttcagtctttttaccgaaagcagtagtactcaaaatggggcagtttaaaaccccaggggacagttgacaatgtctggagacatttttgattgtgaaactgggggtaggagggtgcttgctgccagtgggtcagggatgctgctaagcacccttcaaagcatatgcagcccttcacagtaaagcgttgtctgttagccgtgtccatagtgccaaggttgagaaaccctgaaatgaagtgaaagaacctgcagaaagtctcattatgtcctagcagaaaggattttctctgtatgattaaagattggctttattaattttgacagaacataaaatctaataattaaggaacatatatataccactgtccagatgcttgttttagtttctcttgataatgcagcatgcagcgatatatttgggctgtttggaactaaagattatttattatttaaatgtatgaaaatggttattaatgaataaatctgctggtatattttaccagtcaagcaaattctgatcattttgttttcttctagaagtagatattgcaagtgttcttgtttcattttgccttaagacaaataatatctgaaatttgttttataaagttatcctgatagttaagcccctgtgatgaaatactttatttgatacctgaatattttaaattctagtcctcaaagccccacttctcaaagtatggtgcttggaccaattgtatcagaattcccccaggggcttatgaaaaaatctggattcctaggtcttacttctcataagccaggaatctacatttttcacaagctttctgggtgattcttaggcgcatgtaagtctgagaacgtgttgctttagatctatatttaagatgtttttctttcctttcttaactacttactgcaatttgtgatctttaacaataataatagtaataataaaagtatttatggctaatattttattaagtacttactattctgctctaaatactttatacgttttataactcatttcattctgaaaataatcttgtgagataggcactattacaaatggggaaattgtcacagaaagatcaagtaacttatccaaagccacacagctggtgggagtggagccggggtattaacattggttgcccctcttagctggaaatgggcttgccattttcatgacagggcctcttcctgtgcacttccaccccactacctttggttcgcctgtgttcctacaccacaaaccctccaggataatcttgactgtgcctcagtttacccccagcaattgtccacatgctctttttgcattttcagctttaatctccattctgggaatgtttagatatataatgtttgggtagatagagaatgtttagaagtctattctaggtcatagaagttcatgctccagaatatacatttttatcctggtgcctggaagattcctgtaggaggcagcatggcactgctactctagttcacacccctcacccccaaggaaaagaaccaccacgagcactaaaataaaatacattctcaatgtgcttaggataaagaaaatgactttttaccatggcctacaaagcactacgtggtgagcaaagtacagttttactaatgcatctgaagttgccagatccctctcattccctcccatcttgcttgttctgtcagtcctcaccccaccctcaccacattccctctcatgggagcatccttgcatagaattctgtgccttctgcctggaatgcttttccctctttctccaaagcaactcgtgttcttccttcagacctcaaattgcagaagacctcttagggaggaaccgtcctcacttgttccgtactaaggctagatccgttgcttttgccacatttactatttaatgtttgtttaagggatgatttgtctaagaatttgatgagggttcagtaaaaacatagtgaacaggacttgggttcaagtcccaggtcttccatttacaagctatataatcttgagcaaattacttgaaaaacttcaactcagagaaattaagtaattagcttattcagtgggaaaagaattattaattaactcctgggatttttgtgagggccaaatatgtagttgatatttagataatgatctaatacgtataaggtgcttagcatggaatctgccataactctgtgagaaaggaaagctatttctattaacaatgagaattatagcaattgttgtaataataaggtatgtgggacacatttccaacattctcacatgctctgtctcaccactttctgcatggtgggtcattttccacttcctttagtgtattttcctgcatttttctttgcagatgttcatctttgatggtattttgaaacagggtcaatgctaacttggttccctactaaaacagcctggcattctcaaacaggatgtttgtgatgtaagggggtaagatgaccttagcttttgatgcattctaactgtaaatatttcatgaatttagttccagtttgaatagaaaacaacttaagcagctgctcagactacatactttgaaaactttgccaattaacttacccaatattacatttgaaatttacttgtcaattttttttttttttttttgagtcggagtctcgctcgctctgtcgcccaggctggagtgcaatggcgcgatctcggctcactgcaacctccacctcccaggttcaagcaattctcctgcctcagcctcccaagtagctgggactacaggtgcccgccacgacgtctggctaatttttgtatttttagtagagacaggttttcaccatattggccaggctggtctcgaactcctgacctcatgatctaccctcctccgcctcccaaagtgttgggattacaggtgtgacactgtgcgcagccttttttttttttttttaagagatgaggtcttgctatgttgtccaggctggtttcaacttctgggctcaagagatcttcctacctcctgagtaggtaggtgggactataggcacatgtcactgcacctggcttacatttggaatttaatttgagctgtgttcactgttagtctgcaaaagcatccagatacttttgtaattcatatgttttgaaggtgtctacaatttatctttctttaaattttaggtaattaaaaaataattccattttgtataagtatatgactttcagatcgtggaaatgtatagattggtttcctacctattttcctttcaaaaatagctttctgttatcatttgtgggtctgttagtcccccaaacatggaactcctcagctggactcctcctctgcggctcctttccttctctgaactgtccccgttacgtgtgaagccacatctttgagcagggtatcactgggtggcatccccaaggaaatgtggctgtgctgtgtggcagagcctataccaccatttgcttttctagttaggtaagtgatgtctttccagtatgatttttaacttctttgaaaataaggaaggtaaaaaatgtattccagggaggacatttcagaaacatttcagaaaactcagtaactggattcattgagaactgcctcagattcccaaacagcattgataaggaaaggctgagaagggagagatgagggaaataatcaaactataggttgagcatccctaatctgaaaatccaaaatcttaaatgatccaaatcagaaactttttgatcacaacatgacaccacaagtggaaaacaccactcctgacctccaaatgcagtcaaaatgcagtcatgcaacatagaattgattccgtgtccctaagagaaaggtaaaatttccttcaggctatgtatataaggtgtatattaaatataaatgaatttaatgtttagacttgggtcctatacccaagataattttgtatctgcaaatattcccaaatctgaaaaaatttgaaatctaaaacacttctactcccaaacatcttggttaagcgatactcagtcgatacttaatctccttccacttagttgcaatagcactgtgacagtgcaccttcagatattttagttaccaaatccactggccttttgtgttgggtgattgccttttaaccttgcagcagttgatgcagtttatcaccaacagatggatcttctaaaatcagatcatgttactcaccttcctagaaaccttcatgggctccctattactcccagttcctttagtgtagtgttcaaggccctttacagtccagctttagctgtcctccctgctctcctccaaaccccactactctcctttgtggaatctcctcttgagccagagccattcatgtcttttcctttctacgtctcataccctgtaccttatctccactgttaaaatcctgccagtcttctatggtctgtctgaaagacttggtcagccccagcataatccacaagggacttgcactggccctgagttatcagaccactcgtggtcgtcaacacacctcttcttgctatggttgattaggttttggtgtcaccctcttgaatgagatagaagcttctgtaggttagaaactttatcctgcacatctctgtggctgtctccagtgcttttctcttcagagctcaacaactataaaacaaaagagattttaggtgatttttcattacattttacctgtgttatggctgagagttcaatgaaatcaaaatgtacttgataggatacttgtggagtttattcaaaatttcatgcagtataatgagaatttttttcattttttaaaaaaagcaaaaatatttttatggtgctcttcaactcttaagtatttgttcagcttcgatttgttcatgttgtctgtatgtctattggaaggaacttgccaccagaagaagagtgtattgtggtacctggcaacaagccctctggtggtcatagcccaggagtgagctgagatgtgtccttcttaagttaggatataatgtgatggccatattaccttaggcattgcagtcacaaggtgaagcagtctttccatgttagtaaattacaaactcagcaacaaatgttaaaacttagacaagtggcttacagctttgaataatttctggttaccctcatttaaaaatgggtaagcaattagtgggagcacctggtatagtgctaatgtcagttgtccagaagtgagccctccgtctgtggactctttgacccctacttttgggccagactggtttttcaggatcacataccgttgcccatgagtgatgttgctataatgcttgtgtgttttgagtctttgttgatcctgttaccattttactccattcaaggtgaaccaaagtaattttataaagaacatttctgactatatctcaaaatgtaccagtgctgtggttgagtatacagaggttaggttaagattccagggcagaagactcacacattatttcttttatgtagtcagttttttttttctgcaacggagttgaaattctgtgaattaaagctgtgtttgagagctcttattgcaagtagattctgaattctcctgtagaggttgcttgtgcaactggatgtgaaagtgctttctgaagggtgtgtgtgcgtgtgtgtgttgatgtgatgttgctgaggctgttgtgttatttctttcattttacttttggaatagttgagcccttaaattgatccagtacgtctccacaaataagttgcagaaaagggttttatgctttcccatctagcattctttttatttattactgtagaagagatattcatttactgagcaaatatttattgagagcttaccctgtgccaggcagtctttcaggcactgggatacagcagtgaacaaaacagataaaattcctgtcttcatgagagaggctaaactccagcttaagtatttagaagtcaagattgtacacaccattggttagaagggaaaaagggaagagcagaggaagggaagctttcatgaaaaaaaaaaattgaatcttaaaggatattcttataaaaccccctttgagccatatctaaggcagtttaagtcagtagatgacagattgtggtctgcaaggctttgcatctgtccaggcctcagatctacgcaagtagcttgtacagaaggggattagagctttgtttgctctccagtttagatgccttaaataaacatctcgtgtgtaatgacaccatcttgaaaatagctaaaattacccttttccttttatgcatgactgtcatgggtcaaaataagcagaaggcaggcactgtgtttgttgtcagtcttgggggatatttgtttgattctggacaacaaggattagaaaacttcttgacttaggcgagtttcatatcagcagtgcaatgtccatgtggtggtcaagctctgctgttgacttgaagcttcctgaggctgggtctgcagtgggaaacatctctgggcgtcgcacctaattagcttctgtaaatgctccacgaactgaacttgctgcctttgactttcaaagttttcttcccagtatgttgctttttgtggctattttcaaaacagcttctttcagccgggcacgttggctcacgcctgtaatcgcagcactttgggaagccaaggtgagtggatcacctgaggttgggagttcgagactagcctgaccaacatggagaaaccctgtctctaataaatatacaaaattagcctggcgtagtggtgcatgcctgtagtcccagctactcggggggctgaggcaggagaattgcttgaacccaggaggcggaggttgcagtaatcagagatcatgccattgcactccagcctgggcaacaagagcaaaaccccatctcaaaaaacaacaacagcaacaacaacaacccagtttctttcaggatatgtactcttagcagaaagagacctcagctaatttttcttccagatcatgaagcttttaaaactcaagtaggaaggttgatttgatgccagcctaatgtttttatcatgaaaattgttatgatataagaatacatttattaattgaaaagtgtttctggtacatctgggcagtttcagaatcctaatttctagaccctcaattagagtttatatcccttctcaccaaatgcacatctcagactcgaaagagtttattgtaaaaatgctgtttgtgaagccaagcctatgttcacaccggcatacacgataatttcagtgatacaatcttaaagggaaaagtttggttctcagcaaaacagctgctaactgccaagatgtggctgacctttgacagactctgagaagttctgcaacatcctggaaaagatccatttcatctggagaagcagcactgaggccttggctgctgaaggattagtataattacttcatccctgacagagagagccacagttggaacccacctgggaagccttgtctagggaggtgggaggggtgctggccccaccctttgttgttgaaattggaatctttgccacaatctgttgctgggactggtgtggcagggtaagtagggccaaaggagccctgtggggatttgtctgaacaggggctgacaaaagctggtccccatccagccagcccagggaagttagcaaagccagggataatgaaagtgttcagcagagcgaatatgaggccctagtcgtgagactgcggaactgagggtggtgatggggccaccacaggggtagaaactcacgtagaggggaacaggcccaggcgtaccagccccaggttccagttccagcctgtcccagggatcccagatccccaagtgcaagtgattgttcattcatctgataaacatgattaagcatccacaacatgttgaggtgctgggaatacaaagatgaattttcccttaaggattcacaggctggcgtgggagacagactgataaataaataccgaagggagaaagcagccataaaaaaggtggggcatgtcctggtttgccctgggtagccctggtgattccttttgtagcagcataattattaatagtgctcttggaattaacagaagagtctgagaatgagcagtaagtggtgtggtcccctgggaaatggggtacagccctgcctgaggagctaggagatgggatggaggacccttaggtgatgagtttgccgcatggataaagaataggactctaggctcaggagagaattttctagtcagagggaacagtgttgactcagtcattcatcatacgttatttgggtgcccaccgtgagccatgtactagtgtacctactggggacacaatggacaaaaatcttggcctttttgtgcttacattctagcacagagagagacaaaacacaagagacgttaataaaacaaatggcattttaaatggtgacaagtgctgtggagaaacaacgtggggaaggggcatcagggctgtgggggagtcacgagtggtttactggtttaaatagggtaaccagggagtgctttattgagatgttatatttcagtatcatcgtctaggggtaagagggagagacgtgatgtgttgagagaagaatgttctaggcagaggcaacagcagatgcaaaggtctgaaggggagacagaccgagctagaacagcatggcacatcagtgatctaagttcgtgtggtttcctaaggttggaacctagggtgcaaactgaggatgggcagatgaggtagaagaggaagagcagacccaggtcacaaagaacttttgtgctaaggatttttaagcaggtaggaggagagagaatatgagccttgggatttgaactgctgtgggtgtacagaaaaagagaaactcaacgagaggtttaggtttagggacgtggtaggcttttgcagtaagggacaaggacagaaggctcatctgaggatgggagggacactttagaggcaaatccataggatgcagtggctgaacagaaaaggtgaagagagagggagaaagggggatcagagggagaaagggggatcagagcccagtcacaattcctggctgggatggagaggttcagagtcccaggcaacccctggaattgcaatagcctggagatagtcttgggaagcagtagtgggtacctagaaaagcatggctccaggtaattgacagcagataattgtatgtttctaacatcatttctgataccaggtgtgtgacatttttcccccagcaccaaccagttatctgacactaactgggtgtccaacagttcagtttgtttactggaaaggggtcccccaagagagagttcttggatcttgtgcaagaaataattcgaggtgaatccacagagtaaagtgaaagcaagtttattaagaaagtaaaggaataaagaatggtcatttcatcccatgaacagagcagccctgagggctgctggttgcccatttttatggttatttcttgattatatgctaaacaaggtgtggatttttcatgtgttttccgggaaagggatgggcaattcctggaactgagggttccttctgtttttttttttagaccacgtagagtaacttcccaacattgccatggcatttgtaaactgtcctggcgctgctggtagtgtcttctagcatgctaaagcattataattagtgtataatgagcagtgagggtgaccagagggcagcttcctcgccatcttggttttggtgtgttttagccagcttctttaccgcaacctgttttatcagcaaggtctttataacctgtatcttgggctgaccttctctctcaccctgtgactaagaatgcctaaccttctaggaatgcagcccagtagatctcagccttattttatcgcgcccctattcaagatggagttgctctggttcgaacacctccgacaaactcagttctgacactaactacacagttagcacagaccacacaggtcaaaggcttagtcctacaagagtgccccacttcagacaccagccatgaatggggtaccctgactactcacacttctgcttagtcaaccccacacgtttgggggtttccatgatcctcaggttcaataatttgctagaacaactcacagaactcaggatgatacgttttttaacatttactggtttattataaaggatacaacacaggaacagtccagtggaagagctgcagagggcacggtgggggtgtgtatgcagagcctctgtgcactctgggaataccaccttcccagcatgtcagtctgttcaccaacctagatccctccatctccccaaaaaaacagaattgtgttcaaatttttgtaacccaatctccagctcccctcccctccctggaggtggggaggtggggttgaaagattcccccccactctaatcacaggcttggtctttctggtaaacatccctatcctgatgctactgaggggccccacctgagtcccctcatttgcataacctcaggtatgggcgaaagggacttgttatgaataatacaagatactcctgttacccaggaaattccaaaggctttaggagccctgtgtcaggaacctgagacaaagaccagatacatttgtttttataccacagatgtggacatgtgtattatacattgttcttaagaagccatagaaagcttgtcctgaaatactcgaatcctggcttcctgaagccaggttattgttggagtttctgtatacaattttagaaagctgaattagtaggccacctttttccaagacatgtttaagggtagcaacagttcaactcaataaacatttgagtgttgtgtgcccaggatcccattcaacccctccaagtcatttcccctgtctactgccttatcttttttctttcttcttccattcccaccaacataacatgctgcaatgtttctcttgatttcacatctcctagctaccatgccatttgtttcctttattaccaaactgtttgaaaagttgggtatgcttattgtctctagttcatctctttttcttttgtaaatcactctaattgggctttcatctcccactccactaaaacttcttttcaagatcatttgtgacctccatgttatcaaatcccatggtcagttttgaatcctcttcttcctttatcagcaacatttgacaacatgaccagctccttcctggaacccttttaaaatttggctttctggcctccacattttcctgtctttcccccgccttgctggctgctccatatccagcctccgcattcccgtggcaagtccaggggctccactctgggacctttgcttttttcctctgtaggcattatttagatgagcctacgtgggcttcaaataccctctgtgtgctgatgatgcctcccggatttagatcttcagctggatttctcgcctgacctgcaggcgatccagctatgttgagctctgcagcatctctttggataaggggcatctcacaccttagcacgcttcaaaccagacttaggattgccccactccctcttctctttctcaccttggtcagtggcagcatcatcctttggttactcgatgcaaaactgtttttttccttttctcctattgcacactcagtccatcatcagcctgatcatcctaaccacgtccatagccacttgtgcgtgtgccaggccactaccctcctttgcttggattatgttggtggcctcctcactgtgtccctgcttcaactctcctgttgcctccgcctgcctcccctcaaccgccaactttcttatcttcatgaatgttatggccactgcctagagtgatcttttttaaagatctccatcagattgtttttctttgctgctcacaaaacctgcagcaactcccttgtggcctgcatggctccacttgatctgggctctggccacctccctgactgcatttgttacttctcaccctctcttccccagccacgctgtcctccttgctgcttcttgaacatgccactgtcagcatcactcttgtaccatagaggggctgacttgttctcttactgcaatcaggaatagcaatccctgaaatagccaagtccttccccaatcacctgttattctcttaggctactttatttttcttcagagcatttgtgcttacctgacatcttgccatgggctcattttttgttactttattgtcttttgcattagaatgtcatctccatgagcacttgcgctttattttaccatccctgtatccatagtaattagaacaatgcctggcgcagagcagccactccataaatattggtggagtgagtgaatgaatgaatagattggtggggagtgggagagctgctgttggttagaaactgtagaagacatggttttgtctttaaggattgtccattctagttgtgggttgggggtagctacataagctgcattttaatgtaacagtatacttacaaggaacaagttggaagtgcagaaaaattggtgggttcagaaattctgaagatgccacttgtgttgagtcttgaagaagaatttttttttttaagacagaatcttacactctcaccaagtctggagtgcagtggcgcaatcttggcttgctgcagcctccacctcctgggttcaagtgattcttgtgcctcagccacctgagtagctgggattacgggcatgtgccaccacgcctggctaatttttgtatttttagtagagatggggtttcaccatgttgaccaggctggtctcgaactcctgacatcaaatgatctgcctgcctcggcctcccgaagtgctgggattacaggcatgagccaccacgcccgacctgaagaaggaattcttgaagtaggtggcttttgtagtttatagaagataagacaaaagaccagttttggctatggcataatgaccctgaatgttaggaaagggaaacggtattagagttgagaatgtagagctatttttcaattttaataaaacattccaataccaatctgcttgaatcattgggaagactgaaggattatgaaggttattccaaagtaataggaggagagtttgggataaggaaattacttaaaattgcaagctatgtgtctggaaaaattgccatcttgcatttcagtcatgaactggaaaaaattttcagacttgttaaatatgcctaagtgtatatgtgtgtaaatgcaattttttaatgaatgagtggtgaatgatttaatgttgaaatgatataagtgtaaacagatgttaattcatttgttttacaacagaatttctagttgctattggtgatgagtcacaatgtaatttaggaaggggcaacatttgatatgaagaatactgattttaacctttattaactcttacgaaaccctttgaagccacccccttagtatattagtgttcattggatgcataggtgatcagcttgagatccaaaaagaatatccttgtatcctcagttacagtaggaacttcctaagccttatagatgacttagcctgctttcacataaatttaacaagagaggaataagttagagtatatacattttctactaatctttttccatcagtccacatcaacagccaaaacttaggctgttttagcacctggagggagagatgatttggatggttttgcaccacagacctctaccttgggaaaacacatgcaggcataatcataggttacctgcggaaggtcttaggttactggcttaagaccggagggtttcatttttacttttatcctctatattttcatgaaggatgggtcactaagggcccttggatgtttctttaggaattgctagtttttaagccgttgctttgccttcgaaagacatattttcacactcatacaccctacctcacgtttggccatgcagtgttgctgctgcttctatctatatttataattggtttggccgttattaatagcagaagcttatgcatatttttctcatgtgaatagcattatggattaaaaaagggacattcaaaatggcagactctcatctaaggtcagggaaatgtattaaagaaaagtgttactgaagtataaagatgttaaaggcataaattataaaatgaacacatgtagctatttaagattacatgatagagtgagtcatggctatctggttactcattacctggaatgtgggtatagggaaggaggaagtgtggaaacatgtgcatgggtgttggtcattgttcctaaaacaagtagaaaatgatatataacactttgaacatttgcctcctttccgtaacttaacataacttttattataagaatattatatctatgattgattgttaatgtcatactttgtcttacaggcatagcttaggtagcatagatgcattttaaattttgaaaatctttgtccttttctatatttagagactttaactttctttgatgtttacaaatatattgcattgatctttaataggactcttaaaattaaagccagcgctaattaaaaattctggctgtgaaaatagagaaattgagttcgataaatttgtagctagtgatcagttatacattttttttcacttggcctcttgtggcctactgtttctgaaatcccactgtttgcttcatttctcctctttcacagacactctggtctatattctgttttactcactccacatattcaaatcctgctcatcttttgcggtatatgggaaaccacctccattctgaagcctcttctctaaaggccacttggtggtccaaacacatatggtccatattgtgcattctgtcacaaccatgaccttttatttatatatgatttttattaatcatatgacttttatttatcttatgtatctcattgattgtttcctatttaagtattagacttctacaatagtaagcatctttggaagagggactatacatggatactttgttgcttcaagatcagtggtcttaaaatctgcctgtgtttggttatttatagttaacttgtcaggtaacaccatccaatgtattgtgtgtgttataaaacatacacaagactgggaatttttaaaaagtgatgaatacagaaatataaatagaagttctgatgtttatatttgtactccagtggctcatcttgggcatgccctgggatgcccacacctcactttggagacctggcattaggttcatagtaagtattcaggaaatatttatttttagccttcagctattctgtgctgcttactgacaaaattcccacctattggaaatgaaacttgagtttatagtctgagtgtgtttgagaccttgtaagggggtataaggaacgattagtcagaataaggtaggttatttttgagtggcaggccttcctagctcaaggcataacacaacaaaggtttgtttctcatgaaacacaatttgatgggggtctgttgggttttctcagaggctctcctaaaaatggttactcagatatccaagctgcttctatattgtagttataatatctggcacacatggctttttttttttttttttttttttttttttttttttgagacggagtttcactcttgttgcccaggctggagtgcagtggtgcgacctcagctcactgcaacgtctgcctcccgggttccaggaattctcctgccttagcctcctgagtagctgagattacaggtgtccgccaccacgcctggctaattttttgtcttcgtttttgttttttgagatggagtctagctctgtcgcccaggctggagtgcagtggcacgatctcggctcactgcaagctccgcctcccgggttcacaccattctcctgcctcagcctcctgagtagctgggactacaggcgcccgccaccacacccagctaattttttgtatttttagtagagacgggctttcaccgtgttagccaggatggtctcgatctcctgacctcgtgatccacccgcctcggccccccaaagtgctgggattacaggcgtgagccactgcgcccagcaattttttgtatttttagtagtgacggggtttcaccattttggtcaggctggtcttgaactcctgacctcaggtgatacaccagcctcagcctcccaaagtgctgagattacagatgtgatccactgtgccaggcccacatggcttttaagattgctgtggaaggtgaagagagagcatgataagatcttcattggccagtgcatagtcacatgggcccagcctaactgcgaaggaagctgggaaatacagtctcctcttgtgcccgggaagggagaatggaatgggatttagttaatttatcacatggtctcttgtctgctaggattatttcagtaaggttgttggctgtttggtaatttaacttgtggataccatgtaaagcaagcttctgtgtgaatttaaacatgagttcagtagtataatttagaatgaaagacctcttaacatattttcaattttttaaaaaataataattgtaatcatggtgaatttccacatttccagtttaattttatttgaatgcatttctacagaagtaaaactgttcatccatttttcatgtttctgttgttactttttttctttcacactattgttcaacagacttcagtagctttttggtttattatcaataaagacttttctaatagtgttatagttggttgctattgcttacagaaatagttgatatgtgattattggtgattatttgaagatgttttagtgcattggtaatttattggagtagatccatctttgttccaattctcatattactgattttcttggaaccaatatgtctgttggaattattagaaaattagatgttggtctcttctatattcattcacatattcatccattgggaatttcagtaaaatggttctaaccagctttgaaacttaagccaatgcaatgttaatgtttttggattcaactcttcccagatgggtgatgaatacataaaagtcagtttcccctatattcaagaacttaaagttgtgtttaaggacaactttaattaagttcgttttccacatatgactatagtcaaagatagaaggtgaagaaatatgaaaattttagaaaagattacagaagaatatttttgttaagaaaggagaagaatattgggttttcgcaggtgagatggggaagtttcaggttattgcgtaatgcattaagagttcctatttccataatatgagtcagggcaataggctttcaaagcttctcttgactcagtggtgctatatttttaaattgtagattttttattctgctgaacctgtgtgtgtctgtttgcatactgaagatttttctagatttggtaagagttgcaaatgttacaggtgtaagtgaatgaacaaaaattatctgggcaaatttttagctcttcttataagggtggtttgtatattgtgaggcagattcatccacacccccaccccttatcctcccaccgtccgtccgtccatccatccatccatccatccatccatccatccacccatccatcttcccatccatcttcccctcctccctaaaagcaaagctcttcttgtgtgcatatattttagtcataccaattgccttttttagtttttatggttcagatacatgtgaagatcaatgtgaattaattgttatattccccactttcaaaattatcttccctactattcaaaatagtaagctgcacagtaagctgaccaaaggcagcttagtattttatagtcaatgtaataaaataaatagctttctaaaactcagagcaaaggaaacatagaaaatagatgagaccccagtgaaagttaataccatgacatcttctaagcttactgaacttgaacttttcatttcctggtagtcaaagcaaaaaagggaaatgtgatcagttacattatttttgcatataagaccaaagtgcattgctcaaaagaagcaaagttttctttgccaattagatttcaaagagatttctcctgtgagactgactatgtgaagggtgtcatcatgacaacacctcccaaaacttagtaatgcattttagatagctaattctcatgttactaagtggaagcagcggacataacaccaaagcacagtttaggaaaagcgaatctataaggatttagatttaggaaaagcaaatctataagaggtataagtaagtggctgtcacccttggctgtctgttagaaccagtgcagaattcccttagaatctatagggttggggaaggggaacaaggtttcggctccgtaggtgcctagtatacatctagggatgagaaccataggtacaagtgctgagcttattgatggtttgactcaattaaagagtacaaggaacagatagattgcatatttccttcaggtgccttgtagttctgtgaaagttttttgtgttcatttatttgttttctgttttctcataaatgggctttgaattaaaggtggtcttcagataattggaggttttattctctggtaagggcttagagtacacaatttccactgccaataaaagatccttaattttaaaattcattaatagattggtctgccttcattttatgaaaatttaggaagcaaacctagacttgtttgaatagatggcccctcatctctacagagatttctacagagattaggggccataagtcatatgataaatagaaagttctccagactggaactgatttatgataatgattcccagtctttgggcctcgggagttattgtagggattgctgttttctcaatcagtaggtatttgaagtacacatatttgaagagaacagtcatatgtgagtgagtgtgtgtgtgtgtatgtgtgtgttttaacctttaagcaataaagctagaactactagtctagaatagttttagaaattggcatttcctatttgacaatttataaaaattttagggatgtcttcctttagcaggtgtttagcactaaaatctttggagacatgtgccttcattccaaatctctgtagattttcttctctgtcagcaagcctaccattggcatatagaaagctccagtgagggtcctctggcatcatcctaggacttgtcactgagttgattggatgtgacagcatgtcagatttcagtggcaagaatggcatggaggtgagcagagggttgtcactgtagcttttctaggcagtcttctagcaatttaatttaggaagatttaacgtgtggagtctttgaagatgtattcattgatccaggaaaattttgagtgccgcacctctgcaggtttcggtgattttgttggtgcagaaaacttgttctcaacataaattcggaacactgaaagtaatccttctttggaggaggacgtatttgatttgcggaggccgaaggggactgtgataggtagctcttggtagctttagcaagccatgatggagggagagccttggacttgagtatctggagagcaggtgcagcgtcgtttttatttttgcatcctgtccaatgctgggcacagttgttggcagattgtaggcactggatacatccgctatagaactcaagaaggaaatgaggataaaagtgatacttgttcaaaggggacctagagaactgaccaacagtttttggagacgaaagggcatatcagctggagactgtaagcaaggtaggagggataggagcagcatattctcattagccagctctgaagaaggctgtaattgcctttgctccttagttcaagaactagcaagggcctgcaatgttactagtgcaaatgtaatcacacttttttaaattttattattattataccttaagttgtagggtacatgtgcacaacgtgcaggtttgttacatatgtatacatgcactatgttgatgtgctccacccattaacttgtcatttagcgttaggtatatctcctaatgctgtccctcccccttccctccaccccacattttgacttttaaaaggagattttaggtgactgtttgcctgtgtcttcacattgaatttatacagaccagcattagagagaattgctgaatccaaataacccaaatgaaaaattttaactagagtataaaatagagcctcactcctctttaacttaattcttcgagtattttaaacccacagagctctttgtaagcatatgaatgtgcacttatatatgtctactgaaataacattttatttcatttcctctttgttatttgtaaatagttggcaagcaaacatagactttgaaaatgccatacattaattttatttctttttttgcatgaatatgagaaaaggtgatgttaggattaattacaccagtttttttctgagcatataccatgtgttgcactgtgctaggcactagatggtgagtcttaattcccactctcaaaagaaactgtaaacaaaaaaagtctcccaaacttaaaacacaacatattacacaccatattacaaggctgtaatagatgtagaaataggattttataggtgtacaggcaagggactcctagagcgagctgagaggcagggagttccagggaaatgagccaggaaaaacagcagggccagctctagaggagggccttgcttgctttgtaatctgtagcacatcagtgagaaatcaagcttttaggatttgattctgtatgagtgtatcttgcttggttttgacctctctgggtaaccagaaatcagtctgagtatatagaaatggagctttcatattgaaggtacaagcttgtatcaagcttatattttgtaataaaaatatgtgtactatgtagagctcccaaggacctgatgcctgtctccagattaccctgaagcagtctctgttccgatccaaggtctctcgcttctacccagctgttctgggaggattgtctctagtcttttatcagataactttaagcccctgcagatacgtagtaataaataccaacttcctgcttgcagatccaagtgtttgcttctctcaaaaaatatatatgtaatctgtgtgtgatatttcaacatagtcattttcttgtagccacttctgagatgtattgacatgacttaaaacacttgaagcagtatttgagtgctgtgcatttggatgtgttctgaagcagcactgtctgtgtgatggaagcatgcaagagttgtttgaaaccctttgtgtcagggcactttctgtgtaccaatgttaaatcttcctctagcagtcacatagcttaaagcatggctgtttagtcactccctgcctaaagtccagggccaggctctgactggattggtggagagcatagcaagcttgtaaactgatgagggagggagtggcctctttgcattttaggctaactccagtaaggaagaggagggctgcagggaagagagcctgcaggccgagtggtatatgatatttttgctttacccattcttgtgtgactactttgaagtcattttgttatgcagacactttagcactgaaaacaccataaacataagcaatctcaaataatgtgcagaacagacttggcatcttgagcttccttattgttgaaaccctttacttagagtggcaaccaggacaggggtaagggagggaatgggagtggaaaccatctggaagacacactcacataagccctactatgttgaccatacacagtcctctcagagaaagctgtcagtcactctaggcctggagcctgctcagtctctgacggggcttctctctccatggtctgaatcatcgtcctctgatgtccttttgagtcactgattttctttttaaaattaagacatggatttggctaagtcatgatggaacttacttgttttctatttgaaagtctagaggaagggtttccacattttatctctgttacaaatttgcaaaccttgtttgaataggtacatcataaaccctgggtatggcaggatgttgagcctccggaccacattaggatcatgtcagtcaagactgcccccaaaatccttggaactgctgctaagacatctatctctctggtgcctaagcaaaataaatgcattatacttataatcagagtactcctttgaaccatagttttgggggacagaactgatacaattttgctttgagttctaacaaatttcttacagaaatgtttaaatgtatgaagttaaatctggctacaagggggacaagattaggaatggagaaggagtcatggtaatgaaaaaaactacattttttgacagcattgtatcaagatggcttgtgaaaatgtcttgcttagatatagaaatccccattaagaggttcctgaaagccaaaaatgagagactcctctaagacaatggcaagctggtgatggtaaggaaagggtgactttggaaggtattgggtggctggatgaaagaagaaaagcaaaattttaatcacaaaaacttttttctggtcttagtattcctctcatgctttggggaaaggttttgttgttgttttcaacaggcaacacggaccagatgacttgtcctcacatcactaaattattttctagttagatagtacatgatttctgtaaactgagctcctgagggtagggacagtatcctttgtatgcctctgcctgacactctcctgacacataaaatgtttattgaattaaggagtactgaattatcttaaaattattcccagaatgcttccttctttacagtatcatgatatgaatttagctattaacaaggaagactcttattattcttatttttattattttgccaattcacttttctttctgcacaataatatatgcaagctcagacatttcatggtatatacacagtggtctgtgtgtatgtatgtgcaagtatctgtctatattcaggcatctcattaatattggtagatttaattgaattttgcagccactccatgaaatggctacagatttggttttcctaaacatgaatagattgatgaccttgattctgtaaggcacacccacagattcggcccccacataccttttagtcttgtattgagcacctgctgcatttcagaccaagggtactttatagacatcctctgcacagccctgtgaggcttcaagcacaaaccaaagcttgaagaagttgatagccttttaccgctgcccattttctctcctttatgcattaaaaaaaaaaatcagacagtatgtacttggggttccagttcaaatggcatctctgcctattgccttctgtgataacctgagccagatctctgcacttccacagtatatggtgctattcaggtccccagcacagtgctttctagggcagatggggcactgggggctgtcagagttagaggagagtgttttacatttgactcttgtaaacatgaaagcttcacttaaccaagcagtctaactgtttgggatgtggatatgacgtactttagatcagaatgtgtttctaagttaaagaaaaagtggcatatgaggtgctgctttttaaggctttaaatcagtagggaacatctgtctgtaaaaaatcagcagaaaccattctttttaataagtgcaacattaaatttagcattaagttgtaaaggtgattagcaaggtctgtagagtaacttctcttgggataggtgtttccatgatttatttgcctgtaacaaagtcataaaaatcgatcatgaaattaattgaaataagccatttttgccaaaaagtttggaaacatttgtgttgggaatttgtttaaagtgagccagaaagtctattcttgtagaccatagctgtgtaattcttttaaaaagagttgggtattaaaaggtgattgttagaattcttttgttaaaagagatagtaaaaatgctttaagagcttattgaatttgaattaagatccccaattgcatatttgttcttttctccaaatcaatgtgtttggttaatttctggacaggggaaatagcataatttcctccctgctgtctgcttcctcccagcctctttccttgcatatgcgttggggttcagattttgcagctttccatgacatgcgtctctcagtaaaagtcatcttttccttttctgaatatctttaggagtttacagatatgtttattaccttctcctaccccctttttatgggggaacttagatgtctttcttgttagattttaagcttctagatgacagattctcttaatcatcatcctcagagccctcacagtgagtacaacgcctcttacctcatgagtatccatgaaatcctttgggagccctgctcttctggatgacctcacccctgcttccacatactcttccatttcagttattaagggattaaatcaaggcagtggaagccattcatgcttcattaatttgtgagataacagcctgcagtagcaagggcagataaagaagtagaattagcctttttgcttttgacctcttgccaaaccccaacaggatgctccgctatggggaactttcccccctgtggtggtttcatgcctagggcatttctaggtactgttttctttgaagcaagtttcagaaggaagtcctcagcagcacaagggattgctactaaattccaaagagcggcttccaggccctcaagacagatgtttccttctctctgcttttatatcttaagttcagtccttttccttcctgggataatttagtctctctaaatcccttatctgcttcctaatgtgtgtctccaatacctggcttctgcaatccacctttgaaaaagagtcactctttggcccagttcacattcttaccagtccaatagaaggaaaggtgcttattttgttgagtaactcttagcaagctggtcctgggcggggcagacttgaggatgtccattatgatttgataatggtcaggcctccaggctagaaaaaattttggggtgtccctaagcttctttgtcacaaggattacaaataagagttctaaaatcttgaaagaaaactaccccttgtgttttagattattttctgtaactaggatgtgaactcctgaaataatgagctttgcttatttattctaatgctgaagtaggagagtttcttgtccaattatgtgggtgttacaggaaaggggtcccaatccagaccccaagagagagggttcttggatcttgtgcaagaaagaatttggggtgagaccacagagtaaagtgacaaacaagtttattagagaatcagaggaacaaaagaatggctactctatagacagagaagccccaagggctgctggttagcttttttcgtggttatttcttgatcatgtgctaaacaaggggtggattattcttgagttttccaggaaaggggtgggcaagtcctggaactgagggttcctcccctttttaggccatgtagggtaacttccagatgttgccatagcatttgtagattgtcatggtgctggtgggagtagcttttagcatgctaatgcattataattagtgtgtaatgagcagtaaggaggaccagaggtctctttcattgccatcttggttttggtgagttttggctggcttttttttaaccacatactattttatcagcagggtctttatgacttgtatcttgtgctgacctcttatctcatccagtgactaagaatgcctgacctcttgggaatgcagcccaataggtcccagctttattttacccagtccctattcaagatggagttgctctgttttgaaggtgtcttacacagggatttctagtttttaaaacatcgtaacacatgtgaaccattttatatacacataacattcagatagtatgattttcttccttagtggttacatttgactgccaggattaaagtatatttttgagtgacccattttaaaaaatgtgaaacgtggtatatgttgaggctgacctaagtaatctatgaaatttcacaaaaatattgtgagatctgtgttttgaaaacaagtatgattctaaaggaagaagaaactaaaatgcatattcatcatatcttattttaaagcctgactttcaagctttatttgatggtttactgttgtcattctaaaacagatgtcatcttcaaatgacttatcttgatgatattatttttgttttgtagccagtaaaaacaatccttttccggttatgtagccaaaggaaagcaacatggccacttatgtttaggatataagaatgtaaatgaaattagaaaattacatgttgataaaacagtcttggaaaaaaaatgattgtagctcattttctaagataattttcacctgcattctgccatctgtcatgctatggcatagcatctttgttatattgggatggcaactagggacttctttgagattagatgtataaaaataaaagtgcagtgccttaaaaaaaataagttgttgttgtatggtatgtctttttctattttatttcctttcaacctatctatgattttatattttaaatgtcattcctgtaggcacatatagttgactcttgtttttatattcattcttacattctctgccttttaattgcagtattttgtccactgacatttaatgtaatattcgacatggttggatttaatttgtcattcaattatttatttctgtttcttccctcttttttttctttgttttttgtttccctattcttggcttcttttggattatttgaattttttattcgtataattccatttactttttagttattttggctatagttcttcatgggttgtcctagggattataatataccttaactttttagaatccatatagagttaacattgtcccactttatgtgaaatgtagaaaccttccaaccatttaggtatatttaccatccatctcctcccagtcccatctgttatgtttgttttcacattgttttctttttactgcatagtgcacactttgcccattgtcatttattttgaaaggcttttctaccttttcttgccctgaagcttggactatttaggaatgtttaccagtgttgtggctagcaggggtaactgtaatgtgtacataaattaaattaccatgcttatactggcataggacaagactgcagtgaagccttccaggataaaggtacaaataactataaagacttattttccctaaagttttaccttaagatgtgataagatgaatgtctggtggaagggcataacactaacttgacaatgatatcaaaatgtcaacttggggatattttccaattgggcaaatgtttctgaattaagaatatgagacaattatagatataaagatataaggaaggccaacgtagtgcctctccttaagaaaactcaaggtttccatgcaaaacacaccatacataattccctttctccttttccttctcttccatgtccttgtggaccacctcaatcctgattgggcttagcgtgaagttagaattggggaagcacatggaggttaggcatttttaaaaaacacttttttgggggttagtttagaaacacccagttttaggactaaaccagagctagtaaggaaaagaaatagtggagacttgtatatctcaattgtagatgggaattttgagactgagctattttgagaggtttgaattccaaaggagaatttcctggtgttatttgaaagtactctagggctcaagattaaatgaaaaggaataataccattttgagagcttttgaagaaaatgacttgaaataagaaggtagaaacagttatctaagttcaggtaagtttcctgagacaaatttagttctgttaaacactttggctaatggagaggtccaactaccagttctcagaatggattagattgtctttggagaatgatttctcaagcaactctatagggaagagctggagaggctgaaacatggggccatgtttgaaagaacataagctttggatgtatttcggtgtcacagacatcttttctgctttgcacttgaggtgaaacaaacctaggaaggaaatggcagggtagagaacatggagctttgggaaaagaagccctgccattgtgtctgatggccatgaaagcagaaccactctgacgaacactctgaacagaaataagatgggagaggaacaaaaataccagctagacaattgtgaacatgcaacccagcattccaccgtgacagaaaataacagatgagccccaaaccaaacttctaaaacctaaaagtgatagatacagctgtctggaaacatacttagtgctagggaaagtttggctctcaaagaacagccgtgtagctgatctggaaatgaaggggagatggcctttaaacatcgggctgaccctattcttagagctcaactagaggacagaagaagaggataaaaccatgcccttaatgtggtaggactaaaactgtgtttactcccttacgctatcgtcattatattataattaaccattcatttctctgtgtggtaaataacaatgctgacacggtcacaaaataatgtgaagcatatgggtcacaaccgtttttaactaaagacttctctaaagatttatttaggttccttaattacagagtggcttggaagactggcatgtggtttcagtttatagttataaatgttggagctgatgatgggtacgtgctcttattgccagagagggagaggaacaagattgggagggggtttgtgttctttggggccctcccttttgcccccaccccttgtttttttaaagaaattgaagatctgtgtttataagaaataagtctgatgacatttatactgtccttgagatgggtatgccagtagttacaagcaaatttttccagtgcttaagtactttaattggtaaattttcacgtcactttgaactcagtggctctctagaatcctgaaagaataaatcccttttagcctttgtcttctattaaaattatactctctgttagatgaatgagaccctgtctttgaggacagcagttaagtatttcagcctggatagagaagaaaaaaataagtattcaacttaggttctttgagttaaaatgaactcacaacagggtgatttggtgatcttccaaagccttgtgtttgtatatatgtgtgtgtgtgtgtgtgtgtgtgtgtgtgtgtgtgtgtgtgtgtgcgcgcgccatatatgttactcatttttgaagtaattttgcattattttggaaccagtggtaaatataatgcaaagttgtagccctaggagcatgggaaaaaggtctgtattcaacaatacatgaagaattcagtgagtacgtattatatattggaaaacttcttttgtatttactgtaatgtgttttcctgcatttcttgccaatgatgataatgaaagtggcatctcaaaatattatctgaacattggaggagcagaaggggaggaaggctcataaaaaaatctaagcaatgctttcctttcctacatgaaggtcatagaagaaatgaatttcccattgtttatcattcttcatggagctcactccagtagggactttgccactgcttcgagagcatccactcattcatccatcccttcatttatgacttggtattggttacatttcatgtttatgtctctgtggcataaacatggcataaagattaattagaaaggctctgccctagaggagtttgtattctggtagggaataagaaggtgtgtacataactaattataacacacaaagattttctgacatttattcagggctttataaatttcaaagtgcttgtatgcacttttatttgatcttctaaagtatgtggctacattctccatgttggagatgaagacactgaagttcagccatggtaatgacttgcttgaagtcaagtaggtgttgagatacatctatagggcccagggaattgcatctgagatgttttctgcctctgtgttcattgttttccactatccccattatgcaatggtgcacagactggggaatcagaatgtgagagaaggctaaggccacaagcagctgtgaagcttgagcaaggctttggttgtgtagagaatggttgaaaggcctttgagagacagagatcagtgcacattgttcaaaggaacaagctagaacaagctgttattcaaaaaagaccctggtgtcaggatctttttattactttttttctgtctgtcgttttattcatacattcattcaacaaatgcacttagagtatacagtacttattatatgcaaggcagcagactcactgatatgaaggttacaaaataagactaggggtggctatccttgaggatctcacagtagttcagctggaaggtaagatatgctggcaaataattgtaggagaacatgatgagagagggaagaatgtgattcacagtatttctgggttcaagttatgactcttctgagaatgggatcatgggcttctcatgtcatctcttaagaccatgtttctttaaggaggctagcatttaatttgcaggtctgtgttgaagattaagtccaattgtgaatcctaggacactttactgggctcctggcacatcaaaggtgttcagtaaattgtcattatttatggttccgtatgcctttggaagaaaagccaaagtccttgactggtgtgaacagctctctgtgatctacttggccaaatatacactcttcctgtatcccagtctttcaccagtctcctggctgcagactggttgctctctgcacccttgtcaccctgtggtctatgcaaaatgcaaaggtgctttatcccagtggtcagtcgcaggcgttagctctggccctgctgtgtcacactggcagtggacctcagcaagttatgcctttgctttgtgctggtcttgttgtgagatttaaaatgactaaacgtaaagagcttggaggcagttctggtacatggtaaattggatattattaattccaattactgtcttatccatcctgcactgaagcttcctatcagctcttttgtttttcatttggaacctgcctatctctctccgcagctcatctcttatcctctcttcattatgctttgctttgccttccagctacatcgaactgcacataatccttcaccccacctccatgatgttttggcctttatttttgtctaaaagacatttgtcttgctcattcattctttaggactgagttttccacctcttgagtttctctgagtccattctccacccctttgaggtttgtcttgttctgccatgttttgcacatacctttatcattgggcttaatgtattggctccattttctctttctctttctctcctccttttgacggagaactcctgaaagaaggggtcaagcattaattgtctctacactccagctttttcttgacacatagtagactctcaacaaatacttgttaataaatgaagtgaggactttacctattttaaatacattgtcttattgtcagaatcattttttcaattagctagaaggggcaaaatttactttagtaaattttgaagtggggaagagcaacaggaccactgctctggccttacttgatagaggccctttgtcatcctaaggcagggttagaattttgggaggcttgggctggacaaaaaccctggcaaacccaattttgcctctgatggatcttagagttgcagtcatttgtttgtaaaggcagtagttctgtatttaagttattgtagtaacatcagctatttggtatttgataatatttttcaaatgtttgaaaagatttttttccctcatattgaaacttcagtgtatggtcctgaaaaatctcaacgttatccaattttagacatgtggtgtaacattttctccttgtttgtctgagttacctggattttagtttaacaacccataaatgtagcttgctgggtttataaataaataaattatttatataaataatttcatataaattttatataaatttattaaataaatttatataaattatttatttatataaatagtaaatattatataaaaaataaagcatatcattagagtacaataaaacagtactattttggttaatagagaatacatggaagaaggtaacgtgtcacaatggatgggtttatttatttatggattttaagaattcaaaggaaataaaaggtgatagcttgctttccaaaagcatatcacagtggccctttaaggagcttgtagttccatctgataaacacataataatgatctgaagtctaaggaatttttttccattatcccctgcagctttgccctttcggatgaagcatacagatccctacgagatcaagataaggaccaatgtattctcattactggggaaagtggagcaggaaaaacaggtaaggctcctaccaagcaactctgcagaaggtaaatgctgcacagaatgacaacagcaaagaggaccagtagggcctccttagcaagatctgtcgcagggccactgtgagggtgcttctgcaggaggatactggttaggaacacagaatgttctctggactccccagagaaacaagatgcctatccaaggggattccaaccaatatgaagtctagtgccggattctagacctttttagcgtagtctctggatggtgcaagatctttttacttttctcccaagacattaaacctgtgtgctgttacagattcaaactgcttccccaagaatgccaatttatttaggttttaagagggtacaaacacactctacctttgctaaaaagtgagggaagataccagaaaaatgctaacattttactcaagagttttcctctgaagcctgaagaattgagatttttatatgtattttttagacctggcaagcttcgcataaaaaaaccctccaaatggaagggttatgcttttttccccttgtgcttttaataaatgcaattcatatgattggtggtcttgagtgagaaaataactttacagatggtgcccagctacctggaaaagattcagaagagccacattctctgaattcaaccttagaaacgtttaaagctgctgttatcagtgggttttttttgatggaactgatgagtctgtggaggaggaagatggtgagggagatggtattttcgtaaagtttcatctgtaaaatgcttttgttttatagataagaatatgataattggtcaattattttagtattcaaaggtggaattttaaatgtttctattctacatggctggttagttgtaacatttacacattttgagttcccattgatcaagagaagaaaatctgccataggtgttgagtcaactgactgaatccattttattcacaagctcttagaaatatttgtgccttgaaaggctcactatctacatcgaaatggttttccttctacacctactctttactccacttgccttaggcgtaactcctccctgcaccccatgcagctgaagaaagagtggttagatgaatgtgtccagccccctttcttgagctctttggagacaccgagcaccattgttttgcagggctagccaagttctaggctctaggtggtcagaaatgaagggaaaaggactggcatgtaagagccttaggtaacagaaaacatggtgtcatattgttgaagggattttagttataaaccacctggtgtaggctcctccacatgggacagccaaactccttttgaagtgatgaagtctcaccactttgaatggcacccccctggatttgttgtacaggttcagctaacaaaattcttccttacctagagttcaattctgcctctacctatttgtcttcagtctgctacctggaactttaccatatttgtcttccttctcctctacaggacaatcacttagttatttgaagtcaacattttatctttctagggctaaaaatcccttttcttcaaattttctcattttatacacattgatttaattcattcatccagaaaaaaaattattgaataccaacttagtgaaaggtactatactagggactgtccttgcccttatcacatttcgtttagtaggggagataaacaatagctctttacatagacatatatgcacgtacctatacatccaaattacatgcaaaacataagtggagtgaaggaaaatcacatggtgcttatgagagcacattacaggaagaattggatcttacaaatctctcattatcttggtcctgttgttctggaaacatcctaatttgtcaatatgcttcatgaaattgcataccaaaaaataaacagaatacttgagatttggtcctggttgtagtggaactcttatcctttttctttttgagacagagtctcgctcttatagccctggctggagtgcaatggcgcgatcttggctcactgcaacctccaccctctgggttcaagtgattctcctggctcagcctcccaagtagctgggattacaggtgcccaccaccacgcccggctaatttttgtatttttagtagagatggggtttcaccatgttggccaggctggtcttgagctcctgacctcaggtgatccacccaccttggcctcccaaagtgctgggattacaggcgcgagccaccatgcctggcctattatccctcttaatgtggactctgagcttctattaatataaagcatgtattgactcatactggtctttaaaccaagtaagatattataggatttttttttttttcacagtaacttccattaggtcagatctgctcaatcaactattgatgaacaaaattattttaaacttacatgcagaatattgtatttatttttattaattttggtccattgttacaacctcttgagaagctgacaaatcctgatgctttcccttcccttaggattgctgtcattttgctgggtgataatgatactagctaacccacgttcagcacttatcacgtgctgggcggtgtgcttatttacatgtatgagataagtatttttgttatttcagtttttatgatgggaaaataggaacacggaaacattaagcaatttgccaaaacttatacagtgaataagtggcagagctgggattttgaatgcaggtagtgtagttatagagtccctgcttttatccactgtactaagctgcatctctgtaccttgaacatggtacagagtagttcttgaacatgattctttccgagtgccacactactttgcccatgttggtaagtctccttcaactagcctcccatgtcttcttaagggagggattttgtattatgtttctactacctaatttaatggctgccatacagtaggtagtcagtacatatttaaataattgaatgaacatcatgtactaatccaaggagccagcctcctgtctttatttaagtaattgacaaaaacactgaataggactgggccaaagactgatccatatgaaaattgccaggtctcatttaaaatatgtctatcttactaaaaattagttgatttgcttagttctgggtatctttatctttctccatttttttccttaggcagtctcaactattttccagtaacgttaatgtgttctacatttacactgctagtgaaaatacctcttggctgatctcccagctatgtatttactgcctgtctgacatctctacttggggtctaacatgcatctcagactaagcatgtacaaaatggaactcttgatttctctctttaccctcttataaccaatctttctgatctcaataaatgagaccactagtcaacctagttatcacactagaaatgtttgttatccttgatttcttcctttcctgtatttcccatatcaaatccctttcctaattttgtcagttctggctctagaatatatctcataccaggctctctcttccttttctttttgtccacatggagactcacaagccaccacccattatctctcatgaggattatttgtagcagtgtctaatgggtttctctcctttctctcttgattacccctaattccattttacagaccccagtctttgcttgttcaaatctctctctctctctttatctctctctgtctctgcctctgtctctgtctcttaacctgtgggaaactttacaggacatgggcatcttgagaaaatgtttttaccccttccatgtcactaaccagttctttcaggtgaaacagaatttaattcttagaagcagtacagcttcttgtttgtctctaggttgacaaatgaaaatggtggcaaggcaagttagaaactctgttccttgctgaaggcatctgtactgatgctgtatctacgcccacccctccccccatcctatttgactctatctacaagcacacatattcacttcatattgcttcatttttattttcacttggaagaagaaaagaaaatattcctaagcctctttcattcttacattctttagctttttagtcagccttctttgtgactaacggtttttttttttttaggatattctaattgtatcaattcgttcctaaatgagtcatcagaagtgggttgcggtcattgttttgatgggtcttggccagttcttcatctcctctggaacatgtgttctgagaagacagcacgtccactaattagctatgtcagtatgtgacatccgccttctcagagagttcttaacactactacttcctcctggagccagattccatctcctgatgggctcatgtatcttccttactgaaaaactgagtggaggttgctagtgctgtttcagaggattggcatccatttttcttaggaaaaaaaataactaccaccctatttctctggtagaactctagtagtaaaatggagttcattcttcttttttatagttttctcttgttatttttctgcttgacaatttgttctattggtttcagtgcccaaatcaccacttgaaatcctcttctccttgtcatcttccctggatttagtccttctggggatcctgttgccctttatcagaagctggaaaatggacagcgcttcccagggcttgtcaccctttcctctggtagtgccattgtgtttacagcacatagaattaggtgctgcttcagggaggaggctggaggagggtccaacagagacgctagagcattgcttctcaaatctgtggtgaagcaccagttccaaatctcatgttcatcattactagaaaaatgaaataatagacaaaatagagcatttaaaccttaattttttcttttagtttcaacaggcaaaacaagcaaccaaattagtacagaagcttttaaaagcctacttgcatgtgtagatcacttaatagtctgtggattgaccaacttggagtcgtgctggtccttggaccatacttcgagtaacactgcctagaagtcactcaaagcatttgtgttgtttttgagctactgtgcttcttggaccctgtgatgaactatcgtcttgggtgcttcagctgtctgttatcactaagacgcctggagccgggaggtggataccgctcctgagagtggttcattttgaatacccacttagctacatgcttggtagcacctagcccttgagtccttttcacttatggaacccaacagcttctcctacctctcagtccactgtagacatacagtggtttgctgacttactctattttctttcttttttaaagcagtggtacaaaaactgcttaatattttatgacggttttaattgtctttagtctatcaaattgagtaaagccaagaatattgtgtgttgtttaaagtctctgttttatggagattacttacaggaaaataaaatgatggaagataatatagaaatttcagtatatagttgtacaaggaatttggagtgggggtttcatctcagttttgagcagaagagggatgccaggccattttgaaatgtcatatcatcttatgcactaaaattgtttttgtgtacatgtgttcattaaaaattttgatttagtaaataaatgaaagaagatgattaacatttattgaaggcctggaatgtgctgtgtgcttgacatataatatctcctttcaataaaagtctttacttaatagtttgtatagaaccaccatgtagtattagagggcttattttataagaagtaattaacttaactgggtcataaaccctccttggcagatgatgatgttattggtcttaaacattggagacactcttaagctgcggagttatgtaacatgggcacttagggagaggcgtgaactcttttgagtcctttggggtgctatttaattcattactgctgtgctaaatgaaaaattcatcagacctcataaaagtgcccatgtatttttaggcattgaactcacaactcactcccatgaatacagatggtttgtggagaacctttcaagcactgatgggggcaggggggcagaatatgagggaaccatcaaaactacatttttccaaggacatcagagtaaatctctgggcctgagaagatgatcccaacgttaggaaacataattatttggtttctaattttacagttacatcagtttctaggaactcttcagccatctgctagaagagttatgaagcctgccttgctcattaagacctttggttctaaaccccaaatgaccttatgtatctgcagtggttctccaactggacagtgacagagatgccactgacttactgtagcctaaacattggcgagcatttcacagtgttgaaaatacccacactgaagcagaatagataagtgaagtcaaggccaaaatgtagtgagcttttgttttgtttttcccctgtgtgagaaagacccctctccatccgtgtgtttaatataaattatcagagattttgtggccctctttcagaagaggatgacatacaggcttatttcaataaaaacatcaccagttgtgacttcccttgtaacaaaggctgcgtctctcattgcagggcccatgcatttagtactctggaacacttcactgctgcctgttagatccatttggatgtgcgggagctgggttattttgcagcacagtagactccagactgctaaaaggtggtttctccaagctgtagagtgcttgttttgttgaacacaaacatggcctcattgatttaggcattcactctttagccctaaactctggtctagggctctgaaccaccagacctacaaaagctcaattcctagaaaaactttggtgtcttaactagagagatagagaggtaaagaaggagataaataaatgtgtacgaataaatgtatggccctctctatatgccatatgacctgtagatcaatatgcgacatacatgatattgcctatatctatgaatttatccatagagacctgttactcctggataaatttattagaagctctgtgaaaaaagtgcacaataatccttgcctattctcaagccttttttcccccaatgcagtgattgaatccatgtggagcctgctccattaacatagataggtttaggtatcttaggcatgagattcccatccttttgtcatcatgacaattgtctttccttgaattgttttcccttcctcattcaccttccgctacttcacaatgctttatttcattaaaaagattattatatatgaatttatataattctatgttgtgtgataattacatgataatacatattattcacagtacagtgcaaggtgtcagagaatacagaattcaattagttattcttacccttacaggactttaaaatcctcacacatttaaactgtcatctgtacttcctttccattgtttgtagaaattaattctgatctagatattctgatccagaagtattttgtaacaggccctttgtccattagtgaggaatatgtgttaaccctaaatgttctgccattttctgatgagaagagattttgaccccagaggcttcatatattttgttagtccagctgttgatgaattttaagattcaagttacattcaaacatatatatatatatgtacgtaagtttacatatataaagtatctatgagttagagaaagtgatgaaccaagaattgattctaaacaatgctgttacattttgtctattttaaatgacaatattcttatatttaacagtcaacataattcaaaaaccagactttgaaatatggtggatgatactccatttttgattctcctcagaaatgcagtttttcattatagaggttattatgtaaaggtttgatttgtataagtatataaatatttgaatacagatccaaatttatttgaactttagcaccaaagagtcaaaaggaaatgaagcacaaagtctcatgaggtaactattatttccagtttccagcgtggtgaaatattatgaaaacagttccttaaagtatgttggaccttgtaattcatccttactggtttattaatttctctaaagtagtgcctgtgtaatgaagtacttgagttaaaggtcaagtatatgtcaggaaaaaaaaaattataagagttgtctcttttaaatagtgtgatttttttttttggagaaaatactaataccagcttccaaaaatgacttattaagatgagcccagtagtagaattcttgaaaatagttaagaatctgaagatatttttaacaacttggaaataaattattaaaacagcttgaactttattctcaaactatattttaaaattttatttgaattgcttaaataggttttaaagttaataaagtgattcttaatttcagtttaaatgaatccatctttatatgccaggagatattatgggtttatatatactttaacagccaagtgatgtaagcctgacccaaattccaggagatctgctcctggtgccattttcaaacacatttgaccctgagagaacttgatcccatcttgttctggccattaaaaaggtctctgagaggtcaaatcaattctagtagccaccaaaagattctcattcttggttgattttccccccaccaccaccctgctaaagcagttgtcctctaagttcatcctggaccagaacaggttttcagaggactcaatgtagccgtgaatctgaattttgaggttttgaagtttggccacagtaaggtccataattaccagaataacaaaagagcctgacctaaactttatatatttttggtcagtttacctaaaagaaaacttaccttttcatctaaaatgtgtgagtgtgtatttgtgtgtgtgtgcattagtatgtttgtatatttgccactgtctaagacagttattttgctgataaatgttttcagtctcctagtattacgatggatagataggccagaaatttatgtcaagaaagaaacatatacataatatatgtgagagttcaggtggggatggggaacaaagaatgccactgagaaagcagaaacatgagaaagcaggcctggaggggattgcttccaaggccagactacagagttggatgcctgggtgattgaagagagctgccccagtgctggagactagatagcaccggatgttaggaacctgctaggagggcagcctcacctgaattgaaattgaaaggcagagagcctagaaagtatcctgaagtgagcagggaagagctataccttggactagagggtagagggcaatgtggcccccaggagtgaaatgaaatataatagtatataaagtctttgtctgtaagtgatggctcaggacagcctgaatggtgtaacaggattatctatgtataattcaccagcttttttctagataaaccatgagaataatggaaaatgtagttgaggaactttaaatgttggtggttgtgttatgtggacagtaagtgccctgtaaaagaacggtattgcaaaggtggaaagatggttgtttctcagttacagtctttaaagggagacagcagaaatcaaccacacagatgaccagacaacctatttggattccttttcattacccagaaagcaaattggagagagttacctccaaccattgaagaagcacctaatgtcccaccatagttctgtgctccatgagattgtttacttcccccttaatgtatttgccagtactccagaaacagacatcttaggacttgagagctttatgtgacctgcatagattcttggtcttcagtggctcctattggttgatgcttttaggttgcgcaaaagccctcaggaatacgttgggcagtgtgctcaaagtggcattccaatttttcacgtattattttcccaatggtgggagatgggactggaatccacctgcaggtctcctgtgagacagttaagattgcctcattatacctgtaggcagagagaccctccaacttggaggaggctcacctgcccactgacagtggcagtagagcaaagacttgagacaaagcaggatgtggagagactggtttccttaccttaactacccagaccagggaatatgttttcttctgccaacataaaatagtcaagcattttctgggtcccagttacggaacattagaacaactaattaggacagcccaatcaatggaaaacagattccatagaaaataaattagggaaacagcattctagatccttttttagagttcagcagtgcacgcgatcatattaaaagctctgagaagccttttgataatgaaagtggtttcactgcatctgactcactgtagctccacatccactttggaccttattttccttaaatatctattaacatttcttgaaacttagtgttaaaagaatcagaagctaggaggcagatgccgagagaggggacacggactgatagggaagggataaaaccaccaaagacatgtttagtccccagtttgagctaaaaaatttttaggtggttttatcctttgcctcatgtggcctattctttagcagctttagtaacggggttactagtgaagcctattaagactaccatgtctggaaaaggctgcgtttttttgttattaaatccttacattggctgcttagtttttgaattaagttgaagaataatgaatttggtctaattatgagcaaaccagttttttggtttttggtgtttttttttttgagacagagtcttgctctgttgccaaggctggagtgcagtggtgcgatctcagctcactgcaacctccacctcccgggttcaagcactccttctgcctcagcctcccaagtagttgggactacaggcacgtgccaccatgcccggcttatttttgtattttagaagagacagggtttcaccatatcagccaggctggtctcaacctcgtgacctcatgatccgcccacctcagcctcccaaagttgctgggattacaggcgggagccactgtgcctggccgagcaaacgacttggaacttgtgatttggaacatatctttgaagaagagcagtcttttaaactttaaaaatacgtttggtaaagatacccaggttatcaagttatttgtggcttatcagtatataatataataattatatataaatgattgctttaagaagataattctgatattttgttggtcatgttactaagcagtttttttaacagcccagtgataaactttaagcacagtttttattatgtctgaattaatgacatgtcactgaatagaaagcacaaatattttagaaaggtatccaaaacattatttactcctctaggaataaagacatttgaaaatgccgttagtgggtcttctcccacatttcctcctccccaaaaagattttttaaatttctgtgttattgattaatatggcttattttcatccacagaggccagtaagcttgtcatgtcctatgtggcagctgtttgtggaaaaggagcagaagttaatcaagttaaagaacagcttttacagtccaacccggtcctggaaggtaggatgtgttatgttcattaagtcggtgtgactcaaacagtagattgagttatgtgggtgctttgagtacctggtctgctgggaggtattctgggagggaagaggaaggaagagattcaggccaagacctgctgagcaaataagccgtgttctagaacctcttggcctaagtgtttagcagaatagtttactaatgtaaaatgggcttcctcacttaacagtcacttttccccactcaatttttatttgaattctttaaattttgattaaaaataatcaactgatcatttgcatatgatggtgcagtgctgttttattattcaggataacacctgtggctgattatttttgttgttagagaaatgagggctcaccccgagaaacacttaaggactcattttttccagagtcatagaaagcctaaacctgactggagagtgctcaaattctctatttagttctctgtcttagcttgggctgccataacaaagtacacagactaggtggcttcaacaacagaaacttattttctcaaacctctagaggctagaagttcaagatcaagctgttgtccaggtagattttattctgaggcctcttttcttggcttgtaggtggctgccatcttgctgtatgctcacttgaccttttcactgtgcttgagtggggagaggtgagagcaagctctctggaatctcttctcataagaccaccagttccatcttgagggcctcacccgtcatgaccacatctcaccttgattccttcccacaagccccacctcctaatactagctttttgagggttagggcttcaacatatgaattttgcagggagataagcattcagcccataacatcatcagaaaacaaaaccagaaatgagtttccttaatgccatggagaatggcatacaacatcagtatgaactaccttggcattggaaacagtatatcaaagtctttccctactgatggcaagctattaaactgctttatggctgggcacagtggctcacacctgtaatcccagctctttgggaggccaaggcgggtggatcacttgaggccaggagttcgagaccagccttgccaacgtgatgaaaccccttctctactaaaaatacaaaaattagctgggcgtggtggcacatgcctgtaatcccagctacttgggaggttgaaacatgagaatcgcttgagtctgggaggtggagtttgcagtgagccaaggtcacaccactgcactccagcctgggcaacagaggaagactctgtctcaaacaaacaaagaaaaaaaacttgttttatattgtaagcgacagagggagactctgtctcaaaaaaaaaaatgctttatattgtaagcatgtctttactgtcacttaacatatttgttatggtggagtaaggtttctcagcctcagcagtgttggactgcttacatgttgctgtggaagggtgtcctgtgcattgtaggatggcctgtcctgtgcatctctgacctctgttagctgccagttgcacccctgcccctagttgttacagttgaaagtatctccagacattgtcagatgtcccctagggagtcagaaccacccttgattagaatctctaggctagataggtagtttggtggaaacttttggttcaagtcatagaagtaaagtcatggaaggatgagattcaacacggattaaagcagaactgctttggggtagttttttcccagtatgaagggttaaaaccctgccctgttgtcgtttgtactcaggctcagcctctcctgccctttcagagaggctcccgaacactgagtattcactgtgaccccaagacacacttcccatgcttcagtttcaccattacaaggacacaccatgcatctgtatccccagttagtagcataagagagaaatgaaggcaaatcatctattatgctgtttttgatctttcctccattgcaatatcttaataacgaagctattatggaaagcgatatctctcaattttattgttccaatatttgactttttgtttattgtcttttgcttttaagttggggtgctatacatttgctgtatttctgcatatgtttattttaagagtgctgtgatgtaaaggagaaatgctgaggaatgctgtagcctgcatctgtgactggaatctggctctttattcagtggtatttggaactaggctccagtgcaggaaatagaagaaatgtctactgtgggcatgcattatcttttatgggaatgctttactttttagctggagctgctactgtaaatgaacatttagaacaatgaactttaaaaaaaccaattgaggaatgtgtctcaagtgttctataatggaacacttgctttttattctgtggctcacaataaaaggctttagtgtttagggttgtgtttagtaatgtgcaactcagatttgtttgatgaaaagatggtttatggcttgcaaatagcaccctgaataaagtttctttgaagcaattccttcacttgcccctgaccttcaagccacaataaactgtcctttatgcatcaacatctctagtcggacttggggctgtgcaagttagctaacttggcagccctgcatgttcacacccaccacaaaagactagcctgtgaaaacacaagaaatgtcatcgtcttcatgataactaggtcaatacacaccattatcaaggttacattcatgaaagccttttaactggtggtggacatgagataagaatgggaacctctccagcaagcatccttttttgaatatttttaggtgcaaatttcttcattctgtatagcatttcagctcatcttctgttgaagacagaatttgctgccagggacctaccaaaccatactcagcccaagcagcatctctaaggcaaagaactttgcctgtgttgactttgtaaatgttgtcttaaccaagcttgggcaactatctttttaagaatcaaaaacacagccgggcgtggtggctcacgcctgtaatcccagcactttgggaggccgaggggggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccgctgcactccagcctgggcgacagagcgagactccgtctcaaaaaaaaaaaaaaaaaaaaaagaatcaaaaacacgaaaaagccactccacacaaaatataatgcatcaagtgtggctgctgaattaccggagttaacataggtaagcacacaccctctctccttgatcagagacttctgactgctttcaaaagtcagaccagattttagcccgtagttctcatttgaacactcagtagtctaatctgctccctgtttaatttgaagaagttatggagacctctagagatttgatgcctagcctctgattccagaagtttatttctgttcaccacattattcattctagctgccgtgtggcccctggatcccagtaacagactgggcaggtgggaggcttggtagaaacggaggatctcatgcctcttcccagacccattgaacctgagtctgcactttatcctcatgtagttagtttgcacattaaagtttgaaatggtaaagatgggcggggtggggcttccagagtgtcaaacagggatcgcctctacttatacaacttatgtttaggctacttaatcttctactaccatggcccaggttaacttgctcctatcttatgcacaggcttggtgaaacaatccttttaccctatgactccgtgctgttccctgtgttaaacaagagcactgtgtgtctggaccagcgtcaaccatggggttcttaaacgctctcatttaaaagggagtcctgtgagggatttgtctccaggaaacagctaagattggaacatttgtattttgcattatgggccaaattgtttttctttgttgtctggaaagtttcacctaggtctgatgtgcataaactgatgaaaccatgtagcacttgtagcctattggaaatgactgttgtttccaaatctcttattcttcctgtattccagagctatataattaataatatttaaatagctttattttaaaattaattaaacaatttaaaggttcacatgccattccccatgatctggaaacttcaagttccataaagcctttgataataagtaatctctgaaataaccttattcagtgatgataatcctagaagagcatgaagctttgcttcctggtcactcaattgactactctctagaagtgttaaaaggtgttgaattaggtaagattaagtttacagtaatacttgaaaaaattccatgagtcataggaatgattctctttttctatgaacttgtaagacatggaagctttagcaacttactaagacttctgttaagtatatttctatggaagttttggacagaaatatcattgctacaagttgtattttccagaaatcatagatttcaaatactgtatttgctttatctttctgcttgagattattattatttttttaaccatacatctgtttctttcctactagcttttggaaatgccaaaactgtaaggaatgacaactcctctagatttgtaagtatttgtataagcataagtgttaacactaatatttagctcatgtatgtttaaacaaccagtagatgtttaatatttcttaatacacacatttttaaaataagaggaacatcatctctattgaaacacaaagttctataaggactcttgatttctggaattttccttttgaattctttttggagtaacaagcaatttttatcatgttttcttgacatcttctatcataaaatcccataagcaatttaaatgaggctatttagagtaacactttgcttatctgagtttggtatttagaaatcaagaatcagaaattaagagaaagataaactgggtctcaagtttagggttagggtgcaccgtaacccttgtcccttattcagtgggtccagaaaggatgggatgtattttaaaattaatagaggtaaagtccataggcttggcaacaaaagcaagcatgtggggtgagcgtggggctgtagagtagaactgaataataaaaaccaaatctatttggtgttttgagcttgattgagttggaaaatgctacttctccctacagggtccatctttccagcctcatcccccactactccctggcctgtgccttgcatgttgacgcagtgggctcctccaggcgggccatgctcttgggtgcctctaccctttacagagacacagctgcctggatgcagctgcaggaaatattgagtctgatggtggtgttttgaaattgatgtatacatttttataataaaagatcatttgtttaatgaaccgtcttctcacataccttactgattgccaccagggacaattttgatgatcttttatgcctccttatgtgagacccttcctgacctttctccaccttcttcttttagatcccgtttggctctttcctccttaaggttattttgtgcttaaggcaggacagtgacttcaagggagatagttttgatagtttagaaaatggcaggctaaataaggttcctaattccaaggctgtgaattttttccatcagattagccccttaagttgttataactgatttgatctgtgccttttcctgttgtggtaacatggctaatctcattacataaatagaattagaagtgaagtgtgggcgatagaagtaattctaatgaccaagcttctttatgtgatagagattttatttttgctgtttgcaaattacatacacacacagtatttaatatttgcaaatatatttagtctatagatcacaaaaatgtaaaaacccatattgcttaaaaggctattactactcagtgatatttgaaatctagtgaaaggcttggcaggtgatttggcttattaagtaacttcagagaaatcctattataacacgggtattaggatatgagattaatacctgattatgggctaaatcatttcatgcccagtttttagcagtttctctgctttgtggtctgtgacttgactagtaatatacccatgttttaattttataggaggactctactgtatttaaagttactactgtacctaacagtggtttatgtacttgtactccggggaaattgcaatgtcttcgacttgcaaaccagtctgtgttggtctggttaacctggaatgaattccttgacctcttcactgagtagtctgatagaccctgctatgttgtagttaatgcttgctcatcgtagctcacattttgaaccagtattcccatggagatgcctcacagtgtccgctccccaccacagcagctgtagtttgacatattgagctacgagttatttctgagtggactagtgacatgatcagaacccagcttttggcgagtaatcaggaagtggcttagtgggaatagtgtcattccactatcaactgaattctcagggctggccactcattggtttatccctggttgtcttccttttccattctctccagtgtttattctactctcctcaaacatcctatttttttactctcagctcatgatgttacgcctacttcacagaaatcaccatcatcatcatacaggccttcaaactgagttaatcctgcttcctggtgcctgacctatatgtatgtctatgtacactccttttacctaggctctagattctgtcgcctcctgtggccagggaccaccttctgtcaaaaggatcccctcttacatggtcaacctctgactcctttgacagagtaaccattctttccctcctttgtagctgcttcacctccttggtcccccaccttcttggaggtcctccctgtacactgagtggcctgggccacatgactggacttttttttttcctctctcatctcctgcatccaacctgggcctgttcctgtgactctccgggtagctctcaattctgtttactttttctctttgactacttctacttaaagccaccaacatttctccactaatcactgtagccacctcctgtcagctacatcttctcttgcttctttcctgttcattccatgctagccagggaaatcttgtaaataggcaggtttgatcatggcatccttgtttaggagcctttaaggacatggctttggtgtgacgagaatatctcaaagtaatcatgtgctccaacttccctctccagccttgtttcccactcatcctcacggttgccaattcttatgcctactccttcctggtctcccacctccttgcccacctgacttctgctgatactttgcaattaagatggggcagatttcctactctccctttgttcccgcttctttggcatagcaccaggacccactgtaggacatatcctcctagactggaatatccagttaacctgtctcaattcccccgctagacagtaagctccttgaaggcaggagccatgccatgctttcgcttgtgcctacttcagctttaaggaaatggttgagggacatatccttatgaataagtgcagacctaaaagggtagaggacccatgatgatgaaaaaagagaaggtgcaggagcatgcataagccgataaaaaggcacaaattgcattgttgactgagttccatgtgattgtatttcttctcccttaccctcattttgaaaattaatgagttaaagtaattcttaggacatgaaacaaaactaaagactttacttattagatcaacacacacttttccaaacaagaaacagctgtcacagttactctgttatacttgttactctttaggcaattatagaccagttcttttaacaatcagaatattaaactctatgtgtgtttctgtgtgtttaagatactatctataaagtgtaaaatgaacctgcgttatatattgctattataatctgggtgaaaagccaaaaacagtaataatgaccagtgtgattctgacctgttcataacacataatcttgtatttgatttgagtagatataaaaacagatctctgaacgtttcaattcatttactgatatgtttcaagttcctagcaatggcttaaaacatattctgccaataaaaaaagactatcttcccaaccagtctgtatacacagacaacttatttttcttctgtttttatttttgaattgagtacatatcctccagaagtttgaaaaataatcttaaatggaaaaatcacatgatggctgagaagatttgttcctaaattagcagtgggttatattagctttgaactaatggggtatttagtatgaattatttatggaggcatgttgttttgcatcgtggttatataaactgtgtctttcttagttacatttaaacaaatgtataaaaataagggcttagtctgctgttctctaagaagtacactgagttaacattttgagatgaactagaaaactcacaaaatctttctttggcagggcaaatatatggatattgaatttgactttaaaggcgatccactaggaggagtaataagtaactgtgagtatttttcttcagtccttgtaaagaagttcagaatactaaaacatatatttatagtagaatagtttagatacttgtgtctttgaggcataagaatatgtttccttgctttatatttagactttaagctttgcatttcagattgttttataatagaatgtaatttataaatctttttaaagatcacttaacatctttaccttggaaaaactttttagaagtttgctaaataaatatttgcgctactgttttttatattctataggtctttttaaaatcctataggtctttaaggcaatccagtatgaaaaaaagatcctctaagggttattttctttaacaaaatgcttatgataaaaaaaatataaataattggttttaaattataacttttgaagtaatatttattcaataaaaggagtagacctgtacttcagtcttattttgagaaatgttgcttctcttccagtgtatttaagtgattggaatgtgatacacttgttaggtaaaacagattttttaaccttctttagacatgatttgtgactgtggaagtgaaatattttatgtgaaaagttaaaaaaaaaaaacaaaaaaaacacaatcagatgaggtctgctcattctagcccaggtgcagagttttctaaagtgggtgtatgagtgccacacggggttttcagtgtctcttgtaaaaatgacagtgctgtcagtgctttggagttgtggcacccacagcacaaccctgatgtccctgctcctcttgactcgtggttgattagtttggaaaatgtaagatgatgactcagggctttgtgcacctcagccacagtctggttatcctctgagtcctctgggttttttgaggaccatagaactgaaccttctcctgcccttgcctgcctcaccatcccatggtgctattgggattgttagaatgaaaaaatttatgtttagacctaaaaaaaaaaaaaaagaaagttgactgaagtatccaaagtgtgctcatttatttttcttataacagtggcatttcgtcttcaaaggaaatgttatgctgaaccccaaagaaggtaccggggtaaaatgagacctgatctggttgaagaggagatgggtagcccagaatcccggcactctcagatgccactgagatcttcctgactagccctagcagaagaatgccatttgaaaattattatttagtaatttggtcaaactatgcagctgatttaaaaaaaaaattaaatcatgattcagagagtaaccatctagggctagaggtttctcatctttaaaatgataggattgaattggatgaattccatggttcttcccatttccagcattctgtagttcttaaataatttaacttctggctgggcgcaatggctcatgcctgtaatcccagcactttgggagactgaggcagggggatcacctgagctcatcagtttgagaccagcctggccaacatgtgaaaccccccgtctctaccaaaaatacaaaagttagccggatgtgatggcgcatgcctgtggttccagctcaggagattgacttaggaaaatcacttgagcctgggagctggaggttacagtgagccaagattgagccactgcgctccaacctgggtgacagagtgagaccccatctcaaaaataaataaataaataaataagtttccattttagtttgcccacctacacacttttgtatgccatgtgttcggattgtccatatttataagaatgtttaattattagagaaatgccttgaagagaaagttttaatatgaattgaagttgaatgggatagtgctacctaagttaaatgatttcatacacaaaatatgggagtaaaagtactcatgcaaaccacatacgatgtaaccaaaggcaagtgattataacccctgccaaacttgttaggaagactctttttacaatatatggcagctgatcagagctatccagctagtggtttgcctcagttttaagatcaccattttaaggaatgattaatatttattctgaatgatattcatgagcctttagtgctttctttttacaagacaaattaactctagctataaaattaataaaacactgtttttaaaaatgagagtaggtttactatttccattacagaacttatagctgaacattttggaatgatttaatcaatattactcgaggattttaggaaaataattcaggatgattttattattataaggattagaaaataacttcagttttaaattttgaagtttaagttctaagcacaaatgtcttcttgtcccctgattcttgcagtatccatggagaataaatattaaacactcagttcttttccaattaagattaatatatcttcatgaatggagttcatatggtgtttgttaccatttgttcccacagtgaaattatattgaaatttgtggtagtgagaacaccctggtatttaagagtatcctttgctttggagagaaaaggaatacattagtggtaagagcaggaaatttcatcctgtatagagaactgactcatcggtggtcactgggagttgctgccttctggcagaagggagtttaaagcaatggataaaccaactggtgttctctccaaactaaagaagctaaaagttagcttcttgtagcgtagaaaagaagacaaaatttgccattttgtaggaagtatattttgcctccttttccagcagctgcttagtgaaagcatagattgtcattggctaaaactcttaaccttgaaaaaggcacaatatcccttgagccaattgtgtacccaggaagtggaaaggaaagcccggtaactcctctctctttttctaaaagagacaaattaagtctgggactcacttgaaaactacatatccctgaggttagtgtcattaagagaggtattaaaatagaagatggtaaaacatttgtttcaatagagaagataaaatatagaagcacatccaaatgtttaggtgatgttaaataatatttctcctagtttgttaaggtttgttggtctgataacatttatgtttttgtatttggggattttgcatctagtgttatgaactggaagcttttggaaactagtttttaaaattaacatcacaggcatttggtggcagtttagacagtggagaacatatggtacaagtcgcaagggattctgtcttctagaagaagaatagcacagagaaatatacgctatgaagaaactattatttcagatgtgcatacacctgagcgaactatggactagacaggtcgtcttgttcacattaccttatcaagagtctagtgtaatacctgacacagcaggtgtgtaagtgcaaatacgggcaggctcttttttccttatccattatttggggcatacccgtgagcctacttttgcaactcttgttggtttatcatgtggtttccagtgtctaaacaaaagacggcaaattacttcattctctgtgcctccatttcttcactttgaaatgagaataacaataggactgattgcataggttgtcctgaggtataaattatgtattagtatctaaagcacttgtaatagtgcctggtacatagtgagcactcaataaatatttgcttttttcactatagttatttgtttattgtctctagcctttcaccaaatacatgctctataaggatagagccttagtctggttcattactgagtgaccagcaactaaaatagtgtcaaacataggctgggtgccatggctcatgcctgtaatcgcagcactttgggaggccgaggcaggcggatcacgaggtcaggagttcaagaccagcctgatcaacatggtgaaaccccgtctctcctaaaaatacaaaaattagctgggtgtggtggcacacacctgtaatcccagccactcgggaggctgaggcagtaggatcacttgaacctgggaggcagagtttgcagtgagacgagattgcaccactgcattccagcctgggtgatagagcaagactccgtcttaaataataataataataataataataataataataataataatgtcgaacaccttatatatatttgttgaatgaatgaatgatcacaaaagtaattatgtacagttaagagttttgttgagaaataaagcttctgctttattggaaaattttgtctgaatattctgtgctaatcatttaaaaatacttctaaatgaatgcttttcctaaatcccagaaagtcaaacaaaattattggtagtcagagttctcttgttcctgactttgttcagcttgaaaaaaagaaattctgctaattatgaatggaggcaaatgctgtgatttgtctatgttccagttattcttgctgcactgcctgacaaccccccgccccctacaacctcaaacttagtagcagagtacaacaagtttgggtgtttcacagtattacaactaggttctgagaggaaagtaacatcctggcaaccagtgttccaagaggttgaggaggaagcctgaagtagcctaggaaagcatatggcatgtcacttctgctgtactctatgtagtcacagtgggcaccagcttgcacagtttcaggggcagggacacagatcatacctctcgaaagagtgtcaaataattggtaatcattttattttagacagccactgtctgatagattgtttccagaaatggcacaataatttctgaccctgtgtcgacagccttgattaatcccctctctcattgattcaaagcttgactgggagatttattttgatcaatggaacaattagcaactacagcacaaccagatacttgaggattgtttatatattggagtttgtcctctcttgctgatcttgggaattcactatcaccatcatgtgaatgagcttgggttagctgctggatgaggagagacacatggaatgaactgctagacatatgagtgaggacatcttagcccagacggctgccagccagtcgccagcagacaaccaacccatgagcaagcccagcagagatgagccaagctggctcaggccagaaatatccagctggcgcccacaatcgtgagctaataaatggtattgttttaagctgctgagttttggggtgatttgttatgcagcaaaaactaactgatacaggggtgtgattgataatatatcctttccctcacccagtttggaagcacttgtaaaataggcacaagaatcaagctggagaggaagtggctttattactgttaaaggcaaggttgaggaaagtggcttttggtttatcacccaagtagatgtgttagtagtcctctggcactttggtagtgaggcagtgattgacaacgctaagcaactgctggcctctccttgtgtgcattgccccatctgtcttacagcactgaggagtagagccagatgtgtgcacagtgtggggaacccagagagctgagccctctgtgcacggccgtttccttctgcaaatctcactgctcagcaaagtattttttctcgtcctggggaggagtgagtaaggggccagcacgctgggggagttactctaaggagatgcttccacatggaaatgtaaagcaaaaggaaatggccaccctcctcacaatggagatggaggatggaacagattactctggattgctttgtttttttcacatttctttttaatttacgacacaattggcttataccttcatgtgctatctcgtggcacattgtttaatctgtgtgtgtgctgcattcatgccattttgtatggaacgtggttttactcttttaaattgtttgagatttacagctttgttcttccttttatatcatatatttgattttattgatggaaagtcatcaataaaaggcatgaaactgcctgttagaacacttcctaaaggaatctctgatcagttttctgggaatatatgtattgaggtgaaatagaagacttcctgtctatgggtcagttctcagtagtgagtggatattcgttaataaagtgtctgtttttaatctgcctttttagggtcacaaatcaaaaactaagagaatacattgcctaatttataatacatacaaggctgggcttcttttttttttttttttttttgagttttgagttttgagttttaaagctcctgaagaagacagaagtagtcaatcattggttgtgaagtatctgtagcaatacaactgaaatttcaaaagagcaatgctgtgacttcgtaatgggtggctttatatgaaagtagatgctttctctttatctcagttttactttgttgttcttcatacaaacatacgtttaccatgaaaaaagactgtatttatcatgaaaggagactatatacaaatattgaagaaaccaggtgctgaaatagatctaaattaacctcagattaatgaattaatttattcattcgttaattggtgtttattagggtagtaaatcaagataggaccagatatttcattaattttatttcaggattgggtctagaattttagattcagatacattcatgaacgaactttcaattatctgccttatgcactggcatatgcttgttgtttaatgtatccttttgctttactgaagaggcataaattcattgaaagaacctaaatgcgactgagatgcttttttcataatattagtcttggagcaactggagaggaggcacagggtctctgcgagcagtcagtttgagtgatagcctttcagtcaagctttcattgtctttctcacctcacaagacaaagctgattttttcgtaattagccttaatcaagaatttggaccacttctttttccaggagaggagagtatacataaaataatgaagcttttatcatactatctaatcctttctctgttacatcctaaagtatgtgatgtgatttttttttcttcccgaccaatacatgtctttttatttatttgtcaaaaaacttcatcctccagtaggtgcagccttagactatttctttcacaccttgtgccttggggaggctgtctctgacatgcacaggcacttatacgtgttgtggactagctgttaatgagtcgagctaggaaagcccctacataacggccaggctccgtgtcgatagtcgggtggcggcagcgcagtggggcggggggcaagttctcattcattgtttctttgtccctgcccccttaacttccccactagagtggcttaatatgtttatctcttaccttaaaatggaaatttatgctaaatttaatataaacttaaatttgtatcttgtgaggaggatgtagctgcattagaatatctggaatatctcttctgtactaaatatccagtgtctaataataactcttctttactaagtcttgttagcagaggctcaattggcggtggtagaagtacctaaggcagaagagaaggccgtgccaatgttctgctttgacttaattcaggggcacatttaagtaaattaaaatggtcaggtggtgaatccctatagtgaattgaatttatgttctctactttgagtaattatttggtatggcttcaagctgttagattatgttggtgcatgcacatttaggggaagaaaaccaataaggaatggtcttaagcatgagtaaatttgggggcaaacattttccctgattacttttctacctggaagcttgtgacttatgagaaaagtcataaagaaattgaaatgggaggctctagggtaatagagtaagcattttaagtggtaaaaccttcaactgctttgtaatgaaagattccttatcttgtgtgattgagttgcttaggcgaattcatgtatttatacaaagtacagcatttccaagtgtttaaggacattgctttttttttggctggaaaattataaagactgtaagcatgatacctagtcacccagagctttgaattctggctctattgcttaccaagactgggatgcgagcctcattttctcatttgtaaaatagggattataaaaccaacctcagggaaggtgttcagggttgaatatgataaaaaatgaaaagcactgaacgcatagcaaaaggtcagggaaggttctctttctattttccctttgcacctttccttttaaactcacctagtatcatgtttcacattggaatatgagagtaatcactgatcatatcagtgtgtgcagtttacgaagtacactttgccagcattccttttcatatcgtgcgcaagtgaatattattcttgaacttggtggttgttatctgctgaatcttacagtcattgccatttctacactctgcaatgtctatgagcgtttattcaaaaggtgccaaacattagactggccagtgtgttgctgttgcacagtgtagtgttgtcacgggctttttgatggtgttattttgtgtcttgacctactacagtttgcttttgtaatgtgattgtggaagtgctgccaaacaatcgcttgtcatcattataaggtgccactgtaaggtgagaggacagcagctcacctcgtcctcactcacaagggccttggcatctcactgtgaagagagctgctgctgtttgtttgggtggcaagagcagccaagaacatgtgtgacttttgtagaccaagtggaaggtcatcacgtgtccagctggtgctaaacttcttcccaaatcgctggcacatagtgcgttagcagtagatgacctgtttgaaggaattcgtgcatgaatggatgaagtcaaatgtagcatttgtttatattttttatgtaatcaagccactttcttctaaacttgaggaatttcctataaaaattagcttttcaatgaagaatctgcccatgccctgtgggttttttcttctaaaactgttacaggatcccatagaagctcagtcacatgataagtaaaatcgtactgcatgtttaacattacttatttagtctatcttgtgctttgcatgtcagtttttacttattaattgactgaaacattccattttttagagatggtaactattacacaatccttttttccctaagttatatcccacttgtacttttcaacctttggggttttttttttttttcatgttttctaaatatgaagccttcattattttccatctatgatttgaggacattggcagtcttccaagtcatatgagagctggagaacatgaaaaatctgcagcatcctgcgcctaataatttttgtacttacatatttttgttctttttcagttggctcaattttatgttttcttatgctgcatctctttattcttacaatcttatgtatttggagcacgctaggacttctcattcatcaaatatatatcctttcactctacctaaactcctccacaaatgctggtgtaggttccagaaatacaaattaaaaagtttaatgatcgttcctagattaaatggcacatcattctctcccttaccaagcattatcgtgatgttttagattgcagcctgattagggggacgtgaaatttgtgtgttctctagaattagtgctcaataatgacattactaatttggaattttatagttgaagtttgcctttgcccacagccttttgtatcactattgagtgataagcagggctccagacaagaatatcctcgtcatccctcccttccttcctcctttcccatttgaaaatttgggaagacctcagatttatgggttgaaaaattatctggagtcaatgaaaatataatatcaaataacaccaaattccattcaatgagaaccatctttctctaagacttcaagatatccacaaactctacgttgcttctcccaggtagtggggcatgtgggtgcaagagtcctaatttcaaatcctagttccacaagctgccaactgagttatgtaaactcctggactatcagtgttttcaactgtagaatgataccttataaaagggttgggaggattcagtgagataccatctgtaaaacactaagcacataataagatctcaaagtattaactaatttttattaaaattactaggtagactcataattgaatggctgtatttcattgcttacatttgtaacgtcacattttcaggaatttaatgtcatcataaaaaaccaagagcatttattagtataaaaatgatatttaatcagtgttttgaatgtaacttatttatatattcattatttaaaaagaacgtgacctgtgtaatttggtgattttcattagagttgtggttcttcctgaagctagaactgaaaatacagcttcctttattatttcattttattactgcagaatagaaagaaaaaagaaagtgagaaggaaaaaaagcatggtggatttggaagtgaaacaaatgccatactatgatttaactcttctctttagatcttttagagaaatctcgggttgttaaacagccaagaggtgaaagaaacttccatgtgttctatcagctgctctctggtgcctctgaagagctcctcagtaagtctctgtttctatgtggtgttgttgttgttgttgttgttgttgttgttgttgttggagctgggagtctcactgtgttgcccaggccggtctctaattcctgagctcaagcgattctcctgccttggcttcccagagtgctaggattacaggcatgagcactgtgcctgaattgtttctatgttttaattttcagtgtcacagcactttttgaagcattctctttaaaacatactccatatgctttgccccttccttcttaagaatattttttatgattctagttgaagtgaagaacatggtgtatttgcttctaccacaccccagggtttgtgtaatattcttgtacctcaccagatactgtgccatacgtctccgatgtgttgaggactgtgcagatgattcagtcaactcaagtggaatttcagcagctagaactgcctcagtctggacttggccaaagctgattattaggggagggactaatcatacatttaaaaaataaaatggaagaatatgatttttctgtttggggagagaaaattatcagggttctaattaaatgagtacaattctataaaaacaaattgctaggtgaatatttaagaatagtggggaagacattttgcagttgatacaagagataaagatctgatatttgggattttagagaattaacataattccacaaagatactatctaatagctaatagctaatgatgaaaagtagtgaacaaatagttcaaagaagaagagctatgaaaagtcaacaccacttaggaaaagtcatcttcactaataatcaacaaatgcagattaaaacagccctgaagtatctactatattattatatatgtagatatataatatatacatatactacatatagtataatatatgtagaagtatctacatatattagcaaaagttattaaggatcaagctagcagagttgtcactgatctgcttggagcttgtggtatacccatctgtgtagagctgcgggtgttacttcaaagcgaggacctcttataatcagagcatgccatccagtcacaccactttttggactatattccaacaaaataattcagatatgaatccaaaaaccaattggtatgaagacatttatcactgctctatatttattattataaactagagaaaacccaaatatccaatggtgagggaatcaccaggcagaacacatatgttataatgaaataatatattgaatcaccaggcagacctcatatgttataatgaaataatacattgaaggtattttttattataaaaactctggaaagagacttacctagataagtataaaacagagtttgtgctatcacagtgattaaagtcattttaagaataatgctgttactgatatttgggtataatttgtgttcttttgattcaatacttaatataaaagccatgttaccgatgtgaacaagatatcaaagggaatgagatattaaagattggatttattgaagcaacttaacaacttgtgtctttgattcaatagataaacttaagcttgagagggatttcagcaggtataactacctgagtctggattcggccaaagtgaatggagtggatgatgcagcaaattttagaaccgtgcgggtaagatgtagtactttcatcaagctttaaattgcataccactgcattgctcagcgggagctggtagcaattctgagttttctttaaagtgtagctcattctccctaaggttttagaattatacaagaattctatttttgttactttgatttttttactagctcaaaaatcacacaagattgtgaaggccatgcttttattagagcatgtgattttaccatttatcataaggagctttcttattctattatcctggggtttgactcctttaaggttatttttaaattccaagtgtttttatggcaaaagttaatttccaactgcccttggatcatgttaaatcaaaactatttttgagacagaaaaaaatctttttatatagtttcagaaactcatatataaacccgagcgattagcattccacattcattagaaaagatgattttaaataacactatactctgttttctgtcttaatgtgtgatacacttgacatgatatggtaactgggatttacttgcaagtgagacagctgtggtgatggggaaaggggagagtaggatgaattatagataaaacaaaattggcatctgttaattgttgagggtgagtgaaaggacatgcgggttctttccctgctctctctacttttgtatatgtttgacaacaataacaaaaacttacattactcccattgctgtgtagcctagtcatttttaaaaagccagctgttctcaaaaagaaagtatctcttacagtatgtcgttttaaaaaactgtataaacatcttcatatggaagcaatagtctgttgatccctggacatgattttgtttaaaccttgagtccaagactggttttagaaccactttgcctggcacgtaattggcactccgtaaaaatttatgaatgaacagatgcctcctgttacccagtatcttgggctgggctcttcacctttgcaaaccacagtttttctgatatgtaaaatgaatgaggagcttttctttgtatggagttgtgcaagttggttttgtttctagtagcaaaacctcagtgtaaaaaaaacgacatacatacaaactgagctgctgtggttgaagtggaagtagggacccaaggctctgctcccagcctcctgtttcttctgtcttcctctttatgtgccctgcaacccccgccacagcaccagaggtacccccagggttcctcgaatcacagttggaaaccactgaagatatagctttgtcttttatgggtttttttccccagaaataaatctgtaatatgattcattaaaaaagaaaagaaaataactataagaaaaaaatagttgcttttttttttctctccccagaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatggtacatccgtggagaatcaactttgtttgtttaggaaacttgctttgaacttctccccactttttaatgtagaaagtaaaatttttgctttgcattggtttgagaaagctttctaatgaaactgagcagaaatagaactgtggctaagctttgttttttgatgtatacattttatactgatctgtttgattatgatttagaaagaacatcctaagccttcaaaattattattagcagcacgtgtacagtcactttttgtgtccatcccctgccttcccacagagttaaaagaaatttgtgaattgaccggcattgatcaatcagttctagaacgagcattcagtttccgaacagttgaggccaaacaggagaaagtttcaactacactgaatgtggctcaggtgggtgaaacataatgtacagacgaaagtttcttaaaagtctgtgctaattttcatataagtataaacaaagattttagtttacaggctgttacctgaatcgtactatgttctaggcattgggaacagagcagtaaactaaacagataaggatccctgccctcatggagcttaaaattctggtagagggaattagatgataatcagtagacataagaaacaagtgctgtagcaaactagcccgtggtgtatgatcagtgaactgagagcaacagtagagcagagtaggggagctccctggggcagggaaggagactcaagtgaggtgggaaatgactgaagggttttgagcagaacagtggcatgactgccttgtatttcaaagggtcactctggctgtgatgtggagagcagagggtcagggaaaaaggagtgaaagcgagggaccttcgaggagatgtgcactaacccagagatgatggtggcttgaaccaggtagtcgcagtggagtcagtgagaagtggtcacattgtggatattattagagggtagaggctacaggacttgctggtgctagctggtttaagaggaagagaacaatcaagggtgatttaatgtttttggcccaagcaactggaaacatggagttgtcatttactgatttggagaagacagtgggagaagccaaattggcctccctgccttacttcttgaaccccctctacccttgatattggggccagtgaagtctttagtctttgtaagacacaaatctgagctgctgccttctctccttttgcttcaagttaagtgggtgggtgtttggatggttgcatgcctgtatacgtgcatgtatacccaggcagcttctgcagcccctttcactaaaaccctttgtgctatggcttacgcattttaccaccagtcaatgactcaggctagaattaaattactaacttaggacttccactcaggcccccactttgtccaactgtattcttgttgtctcatcctcataactatccataaagcctccataaatggtagggtggagccaggcttgccctctgttgctgaaccagcctttcctactataatccaagaatgcctttatgtctttagctttcaacattgatatcttattttaggtgagttattttggctgtggcaaataccataactttatatatatggaaatttggtttgtagcaatcgtttcctagctatagccattgcctgtccttcctcctaaattactgcttttgctgtcatatctgtccaagtcatcctcactaattcacagtcagatacgaagtaacttacttaatcaaggaaatgctgctgagagcctgtacagcacaagcccacacataggccctgagttgggaagtaagaggttagggaagaccccatggaaacaatcaaaggatttagatgtgtgaagtatggctgaaagggcatatcaaaaagaaaacattgagaaaagccagatttggggcacatatcagaagaaggattaatcaagcttggctatagctgtagatatgtaaagaggattcagagcaatatggctggaaaggtgaagtctgcagtcagagtggcaaatctgcaccagtagttcttaaacttgaacgtgcatcaaaatcacctggtggactgactgactaaacatggtttgcagacctcacccccagtgtttgattcagtgggtctggggtaggaccgaggaatttgcatttctaataaattcaaaggtgacactgctgctgctgctgctggtccaggatcacattttgagagccaccgagtttggacattttcaatagccagagtgggaattgttaagtctgtaaggaagccatgaaaaagcctgtgttgtttaagaagaccctttaggaatatgtatattttgggtctttttaaaattgtgtgttttactcttgcttttttaatcatcctgtatgggaaccaggcccaggtgcctctgactttataagcttattttagtcaccttacatcactaaagaaaactttccacattttcttaacctttggcataaaagaatttggctagagatcctcagctattcggctccttagtcaactgtttttttttttatttttaatgtagtactcagagtatctggttctactgatctattgcctgggaggttttgattgctgtgagaagtgatttgttttattagcctttccacatagcttcaattcctgggccccagcatcatctttattgccccatgcctccttttcccaaggcatttagacctttctctagataggaggactaatactgaaataatagaaactcaagacaagagtttttcagcttctccgacatactctctccttggcttctgatgtcctctgaaatctgatcccacacagcttacctcagtttattccttgctagttctctgttacctgctgcctctgctccgacctgcctatcaccccccatgtcatgctcattctttctgcccatctaaatgctctacctgattgtgccctatcctaggagacttctttgatcaaataggcctcctgagacaccccgcacccccatcagaacctgttttttttgcagtttggcacctgtcctctgcttgtttcctctgtgttagtttgatctccttagctccactctaagctcctggagggcaggccccatgtctgtgcatctctgagtctccaccttgctttgtcacttgccgtcctagaccatgcctgttactggccatgtctgcagcacattccacctgggcttttcctctctgagtttcatgcagctgcagaagtgcatggtcttttcatagtgtgctttgaaactgagatggtgaattagtgcactttgagtcttccctcgtttctacaccccatattagtggtccttaagtgggaatagacattccttcccttactgctttataggataatgttgtggagatttggtggcatgaatcaggctcaggaagtcaggggtggcacattggcagccaggtggcaaattggcagctcctagggccaggtaaagctcaatatttttagttgactaaagggtagtattttctttggttttgtttgtttgctctttaagttttgaatttgagtgcctttagcctggaatgcatcctctaaccccaatagagagagccatcatttcctgttcatttctatcacacagtccctggaaacatttgagtttgagacccctggaataaatattgttgaagaaaccaaagaagattaatattggctgtgaatacactttaaaaaatataaagcaatttatcagaataaattgtcactattagttcagttgtttattgaaatagtggcttgttgaaagtagatagcatgtaactaaaaaagctggacgacattaagatgaaaaagggctcatttacaaaaacatggtgttttgaaattatgtggtgttttgagataacttgaatttataagaagaaaaaggaaaggatttggaaattatatagcctcatgaggtagtagtagacgaaaaggatacttcagaaatcaatataagtacatctatagactaactgtgtgctaggcattattctaagcacttaaattacctattttaagaaagcaaaaactagaagaaagggtattggggaaagatgcatctaaattatattttgatttctctgttttagcatttgacatgcattttctactatggaagcattccctcccttgtttgtttatttgtttgttgccaactcttaggtatattctctaaccctaattggagtagggagggaggtttgggattagcatggaaatgtcagatgaagggaaaaggtgttatcttcagctgtgttatgttgccagggaagtgaatctgttattaaagttgttacattttatttaggaagaaatgtagagaaagtattcccacataatctaacaagttgtgctctttgtaaaataaaaatgtactggttaattttaacagtaataccccaatttttacttagaagcagcaaaatacacacatacggccagcatgttgaaaatagcaacaaaacctcaagctttttctctcccaaggccagttccttgttaggctgctgacacccaacctccaggcctccccaggatgctggtattaaacatctcattagtacttacttactgtatgctctgggcactcggtgcatttaagggtgtttagattcttctgtccaaacctgactttcttcggcctttggattctaagagtcatagagatgcatatgtcttctgcctctttgtcaagtagttctgaataactttaaaagtagataagcacgtaagaaggggtttatgttcattctataacttaaaagaactcattgtggaagtttttttaaatactcaagtgattagtgtggccaggcatggtggctcatgcctctctaatcccagcactttgggaggctgaggtgggtggatcacctgaggccaggagtttgagaccagtctggctaacaaggcaaaaccctgtctgtacaaaaaatacaaaaattagccacgcgtggtggcacacacgtgtagtcccagtcactcgggaggctgaggcacgaaaatcccttgaacccaagaggcagaggttgcagtgagctgagattgtgctactgcactccagcctgggcaacagagtgagattctgtctccaaaaaaatttaaaaataaaaaaagattgagtgaagaaaaaaaatttgcagattccatcagtcaaagccattttcatatatctcctttgaatttccatttctgtgtataagggttttaaaaaatagttatcatattaagtagacagttgtttaattttcacattacgcgagcatttccatttcattacctgattttcataaccatcactctctgatgactatgtaacattactctcagtgcatgtttctcttactaccccctattgttggatgtctaaattgcgtctgatttttctctgttccataaaattgaaataaatatctttgtggtgaaagtttttgcagtatttaaaattagtttcctggtttgtgaaaaagtgtaactgtgtataaacaatttgcctaattctcttaaaggtttgattgtttatgatacaagaaaactggttctgcaaagatgtgaaataaaagagcttcaaatattttttaaaagtatctttatgattttattaaaagtaagcattgtggaattgtgggtgttaagttttgtttgtttgttttttaataggcttattatgcccgtgatgctctggctaaaaacctctacagcaggttgttttcatggttggtaaatcgaatcaatgaaagcattaaggtactgaatttctatgagcaaaatcagttgtaataaatggtattcacagtataaacattaagttgaagaaagtttaaatttataatcaaataattgattgccacttacaaagattattccttaaaaagagtgtaccatgtataagattgaaatttgtcagggattttgtttattttgttttgccatgtgtgttgcttctgactggtgaatagtctgatggtctttgtggagttactctgggagtcggcgtcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggtaagatttaaaattttttttgtattgtctttagtagagtggaatggttggaaattaaatcctgtattatgtagacattataagtaactgtaactttgaatctacaaataatccttgtgtagatgtaacacactatcactttgaatctgccaacaaatctttgtgtagatgtaacaaaatttggttgtgtattcctgcatgtgtgcctgagtgtgtgtgtgtgtgtgtgtgtgtggtgtgcgtatgctgagagccagcattttggagacagtactgcttaaaaagaactcgtattagtacctgacttttgaaattgcgtatttaaatttctaaccgtgaggcttccaacaagctacaatgagtatgtctgtggccatttgtgtgttgttagaaagtgtggcaggttggtgccataaagaaagccacaggagggctggacataggttctggccttgccagggctggtcatttcatctgtgagactcagagaaagaggatttggattaggtgatgtgttgagtctcattactgtgatcttatgataatgaattctgctgcagaggttgaaataatttctgctgaagctcatggtgaattttttaaaatgattctatgcttgttacagattaaatatttaaaccatttgtgcttggttaagcaacacatatacctaaaattagaatgatatagagaagatgagcatggcccctgaaaaaagtgatttggaaaataaacattatctacttatgttagaatttcctttttgcccccttgctaactttgacatttagaaggagttttaaggatctattaaaacatttattctcacttttaggagtggtattttagtttggttcacggaaataagaagtagatcgggctcctcctttcttaattctcctccacaagtaagatttgtgaatttctttaaggaaccaggctctgcccagaatgttcccaaagaatttacatgttctaaaaaattagggtcacagaatctcagaaaaaaaacatcagatcattcctttcacctaaaccagaccttgctagcacatgcctttttcttagtatgttttccctcaatcatattctatatttaatagctaatggtaagtactaattgagggccgactgtatgtaagcactgtggtaagtggtgtgtgtatggtctgatttacttttcaaaacagcctcatgaagtagctgttattattatgaattccattttacagatgagaaagtaaagctcctcaggtcaactaactccccagggttatacagctacttagcggcagactcaggacctaaactccaggcccttttaatattttcatttattgcttttctttcttactaagattgagaccaggggcacttcctcacctttcttcccaaagtaacaggttccccagtatctggaagtaagaaaaaaataaatgtggtaagtctctgactcccctgtttctccacccttgtcattactccaagctcctggccagcattgggtgcttcgtagatggaagtgtgtgtgctggtggcttccccatggggtccccagaacagaggtcttcaacacagcatctgcttgtattgctgcccatttagcagaatctacaaaggaaagctaccaatttcttggtagaaagggaagaatttgaggtttctgagttaggagaaatgcttgagtacacacagaaatcactgccgaaattaatttctttctagcaagacctcaagttactatcactaaatgggcagaatgccaaagtcattctttacagttggcagggaaaaagacttactacctagcacattgctgtgctaatctagatttaaatggtttcatgagcaggggagatgggtaagcagagatttcactagaaagttagattaagaagatacattcaatgacatttccaaagtcaaagaaactgattttgttttaattttgctagaaaaggattattgatcttaagccagtgggcaatggcttaatatcatatcacaacacatggaaagtttaaaaaataggataatgaggttatgatgggatatctagttaactttgacttccagtaggtcctaagatctaattagccatgggaaaagaaacacttataacactcaaaggaaactgagttataactcataaacaattcgagtcatttctcaagtgtttattgagttaccagataccagtagtaaacataactgagatattccttgtctgcatggagcttagagtcttagccctaagattgagagtctgtggctgccagaggatgtatcctatcaggtaggaaagtctaatcaggaaactatattacgttttaaaagtttgtttgctacagacctaatcagaacagaagtcagatgttcctgtgtaaacatcctttaacttgatgctgggtgaaataccctatacccttcagcaatccaagaatatttttcacttctggttaattcaagtttctctccatacctgtcttgctgaatgtgccctccttctgcaagttataccatcatttttctcaacactgtttcaactagagacttcagtttatgaaaatgcctgcgttatatttccttttttttttttttttttttttttttgtgacggagtctcactgtgtctccaggctggagtgcagtggtgcgatctcggctcactacaacctctgcctccagggttcaagtgattttcctgcagcaccacgcccagctaatttttgtatttttagtagagacagggtttcaccatgttggccaggatggtctcgatcttttgacttcatgatccacccacctcagcctcccaaagtgcagggattacaggcatgagccaccgcgccggcctggctgcctgtgttacatttctaaatattcttcctttcttcagaggattactctatttcagtggttctcaaatggctgtgcattggcatcacctggggagcttttgcaaattcagatgtctaggctgtacccagagcaattatgtcagaatctctggagatggggctgcagcagcaacctttttaaagctctgaggtgattccagtgtgcactcaaggttgagaccaaatgctctgttagacagtagtctctggagtaaactgcagattccaaacatgtggtgttcatgctgcttggccactgtatgaaacacccttgtaaaacattgggcctcacctactgttcatctgggcatggtggctcacacttgttatcccagcactttgggaggccaacgtgcgtggatcacgaggtcaggagatcgagatcatcctggcaaacatggtgaaaccctgtctctactaaaaaatacaaaaattagctgggcgtggtagcttgcgcctgtagtcccagctacttgggaggctgaggcaggaaaatcgcttgaacctgggaggcggtttttactccgtttaaacagaactttcagccaaggccaaatccaatcagttatatgtctatagcaaatcttataatggccatcaaattataaaaatttaactttccttctacatgcagtaaataatttttctttttttccccccagttccttgagagaatcaagatttgttttttcattatatttaattgttacctccattttcctttttaagccttctcagattaatcttcagttttgatttttaataacttttttaaataaatttatttgtggggaggttagattagcgatttggttggggatttttaggtacttttacctgctttttaatacagagttacagacgtgtttttcttcttttaataaattattcacatacattcccagatgccagcctatattttcctggattctcagcaatgttagaacacatggagacatcaggaagctcagagtgttaggaaaccaagaaaattaagaactttaaagtactgcaagttgaagtacaaggggtcagagtatggaagaagtattcagatccacatcaaggcaaaaatgaaaatttctgtgatattttccacccaagtgaaaagaaactgctggagtatagataacatgtatttttttatttgttctgttgttcttcaattgactgtaggaattaagagttctgccttttagaataccctgggcatctctttaaaaactggacactaaagggcgagacttttttaaaaaaatgcgtctagttgtcccatggccctgcagttcccatgaaaatgccttttttagctgagctggtggaaacctttcattccctgtggtctgtctctgaacggaagagggaaactgatgcattaaaccatgggttgatgacacatggatttgactgcaaaacatcccagtaccagctggaagtgctgcctggctggccacatgtgatccgatgtcagtttggaaaatagatcagtagaacattgataccaaaaataaggtgaagtgaattaaaatgcatagaggaaaaaaaatctagctgtacatcctggtagaacagaagaccaacttcccaaaggaagaaaattgtaatgcaaatactctgattccacacatttatgtttggacattcttataactgaaaagatggtctgtgatttctgagaaatatttatagcatatccataaaagaactgctattctttttttgaaaaaagatattaagttaaaaagtaagttgaacaatctacattgatttcagctcgttttctacatacttatctgacaggcattaaaactggcagatattttactgggaaaatctgattggtcattagtgttctgtagaccaaagcaggcagtagtagctgattatttcacctttcatacagtggagctagtttaacacaggcaaagtgctaattactttcagttatggactccttatttatcttgccctcataaacctcactgaaagtgacccatatatggtaagagtatgataggctggatgcaatgattatttcaaataaaaaaatctaatacttgggcaagagtcattgtagtctggtaggtacacctcatgatcataggatttgttttctaaattgtttttaaaagaaattctggctatagtcagcaccttctactctagtttcttgccttcatttggtccttcttatgctagaaagcttataattgaagaggaaggaaacaatttaaagtagatttaaaaacaaaagatgacaactgctatgatttgtaaaagatagatagatagatagatagatagatagatagatagatagatggatccaactgtgtgaatagccagcaattcctgaatcccagagccgggcactcctccccatgtgtcagtctcatgaatcaaagtcttatagtgtatattttatggatatgctgtaaatatttctcagaaatcacagaccatcttttcagttataagaatgtccaaacttggcacggtggctcactcctataatcccagcactttgggaggccaaggcgggcagatcacaaggtcaggagttcaagaccagcctgaccaacatggtgaaaccccgtctctactaaaaatacaaaaattatccaggcatagtggcatgctcctgtagtcccagctacttgggaggctgaggcaggagaatcacttgaacccgggagacggaggttgcagtgagccgagattacaccactgcactccagcctgggcaacagagcgagactccgtatcaaaaaaaaaaaaaaaattcaaacttaaatgtgtggaataattggaatatttggattataattttcttcctttgtgaagttgggcttctgttctgtgtaataatatgtgtgtatttcttccaggtataaaaagtttttagatgaaagcctattttaaaatgtttaagaagagcacgataacattgtttttcttaaaatttgctgtattttagtatatacctggaagaaaaaatgttaagggaaattttctaaacctttagctagtcattcaattttgtaaatgtctaaaaaggagactatttcatattaaatggttttctcatatattttgaggattttttaagtttacattctaaaaaaagcaattcttgttttggagcctgtttcttgatgctgtgatatttaaaaatggaccgtggttaagtgcattatatttttctataggaacagcattataatcagaagctgtcaaaggctttaacaccaaataaatctttgcaaggaccaacagcatattttacagcaataatatagcccaacttccctaaaatagtgatatacactcaaaatcctgtaacttttatataaatgcattgactcatttattatgcaggagactttactgtatgtaaaaatgtagaaacccccaagccagcatgttatattcaaaatttgacctcaaatcaaagtgctgaactataagaaacactaatatgtaattaacataagccatggtctttgtgtttggactgctcgctgtttcaaatacattatattcacctacagactccttcccatttctctgtcccaaatacagagggacagagctgccacttctatttactgtcttcctttcaatatttattgtttttaaagagcctaagagtttttaaaatacctgtcttccttaaagagtataaaatatcatcagtctcctttgttgctaaggagaatatacaaaggggccagtatttttgatacatcttaatttatattggagagtttatgattgatacttgtgagtataaagtagttatgaatcgactgggaataagattttctgggctttgtttttttgttgttgtttgtttgttttgatgttgaaaggatggactcaaagtctagaattcttaaaagaagccctagcgtttaaaatttgattatattatatacttctaaacatagtaagtgctccctatcccaatctatagttggtaactatagtgtgaaatagcagagaacagacaccttgctgtttgcctttgttctctaaagcagcctcagcttcatttagggaggttatgtaatagaaagcccagaaggtacttgtttgaagatgtttctaagttttagttttattccttagtcttcagggataaatgtgggtaagacagtagagaaaaattgcatacttggagcatgggtggaaaactggagagaggagatgagtcattcctggggcaagttcctgcccacttcctcttctggagactttgattcatgagcctgacacgtgggagagggcctggctcagggattgctggctattcacacagttcttgacaaaccaaaaaagtctccacatataaagttgctttggggccttcctattcatctggtggtttctagtctcagtttagctattttatgaaggagagggggcccaagttgaaaaccaggtattaatttaatatttgtattaatggaaaaatgtgttagacctatacaagttagagttctgtgaactgctgccaggctattccttaattttctgcagattattgattattccttaaatttttgaaagtttttaatcatatgtgcagtcccattttcctccaaatttgaacaatgccatcaacttcagcttagatcacaagagaggtgtgtgtctttagccttcactttgagcagtaaggatcatctaggtgacccatgacatgttttggagactttggaggtgagtttgcaatagatgctgatttctgtggggaagtaagttaatttctacatcggtgattgtgctattctatttttgttttggtttttttttggcggggagggggcggtgtttttttagcagtagagtaagttcagacagtcaagtttttgttattagggcatctccaggagaatactctctccttattggtttttgaaaaggagccttagcacggtactacacagggatgtgtccctggggtgggaaaggggagttacttttggattatgatggatctcttcactttttggtgatctgccaaccaccactgccctgactgtttgggtggatgtggaccttggatacatgtcatgcatgttttctttttttcttttttctttttctttgagcaacatggctgtttatttcacctgggtacaggcaggctgagtctgaaaagagagtcagcaaagggtggtgggattatcattagttcttataggttttgggataggtggtggagttaagagcaatgttttgggggcagggggcagatctcacaaagaaccttcttaagggtgggggagataacaaagtacattgatcagttaggttggggcagaaataaatcacaatggtggaatgtcatcagttaaggctattttcactttttttgtggatcttcagttgcttcaggccatctggatatatacgtgctggtcactggggatacgatggcttagcttgggctcagaggcttgacattcctgtcttcttatattgataagaaaaataaaatagtggtaaagcgttgggacggcgaaaattttggggggtggtatggagagagaatgagcaatgtttttcagggctgcttcaagcgggattggggcagtgtgggaacctacagtgggagagattcaactgaagaaagattttgggataaggggtgatattgtggggttgttagaaggagcatttgtcatatagaattactggtgatagcctggatggcatgttttctttttcctgataatttataattagaagcattggattttgaagctttaaagcttcaggcaagttatatgatgtatcattatttcagtcaaactgtttttatcctgaagaaccctcccctagcaaaccacagttcagacaccacaggaaggtattgtggtcctgtcttttgaattgactggatatgggtcttgatccaaagttttacactgatcaaaaatacagcctgaatggtaaaagccatcatttgtaaccatgaataactatcaatacatgctcacttttagaagtttattgctaattaagaactgactgcattttgtgtaatttgtccctttttgcaccagaatgcagtaagtatgacctgtttgcagtgctggtctgttgcatgctcttgtgttaatagcttctctagctgtgtgagttttgcagtaagtggttgttgaataaccatgtggatataaaatacagaatccatacaggaatttttaaaggttatgggcaaatttaatttagttgtaacttaatccttaaattgttttgtaattgtgaagctttgcctctggtttctaatctgcttgtgtgtatttcatggtcctgttttagaagtgtactttgagctgttcatagctacacaatgtgtctgaggacactagtgctttcctttccttctcattatttgctgtttgatgatttagcataatagggttgaaatagctccatgggcacagacttgccagataacacatttgttccatgagactgttgtctaaaaaaaaagtcaaagatctgctcttataagttattaatgttttacttttacttataggttttatttatagttgcatcatatagggacatactttagcaaagcaattgagactttctgatatatggaatgcctttatgctgagtataataataataaggcatctatactagaccaacttcagtttctaattgaaattgttagctctgcgaatttgagcacagggttttaaaaaatttgtgtgaaaatgaggactgaggagtgccctttgtatctgactatatttgtcaaaattattgaaaataaatgtttgccttttagtaagactcttcaagacataaaacaaacaaacttttatccttaactaagtttagcattaacaagataagtcactgacaatatattcacatgtgttatttatgagtttgagtttaaaatttcctctgatcactgcatcactggtgattagaaattcctagctgacttccaggaaagaatgtagttagatgctgcagcataagtatcatttttaagttttcctaagtaagaccaaagttgatttttaaagatcaactttcagaagactctgtgactttttcacttctatcatgtatggagggatttgaaggccagtggctctgcctgttcacaaggagcagtgagctttggctgcaccattacatgtgggctctccttcctcattagaccaggactggccaccattgtgggagaagagtccagtttaccagtggtggagtcatactatccctcgctcccactgccaccatctttgggcgataaagaaaaatagaggtgaaaacaagttttagtgtcagatctacttcttcctggacgatgtggttcttgataaatttattcatttggtgctctcaggatgtacagcaatacattaagccctgcagattgttcagaaatgatttaggcataaagcttctgtcaacaaattcataagagattaatatgaaggagaggctgctgagacttctaagagtgatcaagggtatgggccttctacagagagagagattgtttcttgtcagggagatgctttaatctttgggtctccatttggtaggaacttcatttgttcatacagtcagccaatacatattgagaacttgctaggtgtgaggtgctgtgtaaggggtaggaatacagtgaacaagagagcatggtcagccctcacccataagaatgtacagtctagtgaggcagatgtatatgaaactaatctgtacatgtgtatacttacacatacacacatgttcgtataacatgatttacaaaaagggttaggatgcaagagtcagagtgagggatctgtccctggatggggacaataaggggtcagttcagggggacttccttgagctctgaagtttcacctgagaatgggagattcagaacttggtgacagagattgtggagctcactgtgtctttgctgatccttcagcaaaggaagtgagattgtttctagcttttctgtttggggtgcttctctgtcaactaaaagtcttcatccttcaaatattgcatcatttgtgtatacttcattcattcacttactcatgacccactcctcgagtgcctgcaatgggcaagcgtctgtcctaggagccgtgtgctgggccacagttaaatctgagagatcatgtgtggcatttctcatggattgagatgtctgagtgtcattgttttgagagagctagtggcatggtttataaagctgtttttcattttctccatacaggacaacagctttgagcagttcattattaattattgtaacgaaaagctgcaacaaatcttcattgaacttactcttaaagaagagcaggaggagtatatacgggaggtaatgttgaaatgctatttttaaaagtgttggtccttttttactcgtaatataaattctaattcagaagatagcctaaacaagaagccatattcaaaaggctacatactgtatgattccatctgtcattctagaagaggcaaagctatagagactgattacctataagaagctatagagtcagggattgccaggagataggagttgtgagagggttgtggctgcaaagagaattttggggactgataatggtggtggttgcttgacattatacatttgccaaaacttagagaactgtataccaaaaaagtcagcatcactgtaagtagatttgaaaatattttgagactttgttcaatatcaaaaagtattgagtattcaaatttatagtaaaaataggtaacagttactgagtccttactacatagcaggtattatattaagtgctatgtatagattatctcatttaatataatcttaaaataaccagaagtagtgtttgcagagtcttttcatcattaatttaaaaatatatatttgcttttcacccttttattttttaaaatagccagtcttttttcaagtgtaaaattagttatttcaaaaaataaaaaggaattgttatgtttatatttttatttccttttttgtttatttgccttaatattttagtaatgatattacctgttttcctttattttcttagtatcattttaagccattaaggacactgaattctcttttatctttctttccatatagatttttctaatgtgattgttatccccagtggcttagtaaaacaacccatttactcaaaagctaaatcataaatatttcatctttattttagagtactcattatgcttcagaaatgttttatacttgtctggcaccttttagtaacataaatattctaaaagcacgattcattcttttcctgtcttctcatcatgaagagaatgcccaaactttgatgggtaacttaaaacagtttatacagattgtttaaaacacttctaagaatatataggaagattgctagcttgctgtaatgaatagaagacaaataaatgtttacatttatggacagaatgttaagtagacacagaaagattacatttggctttatggatttggctttgtagccagtgttagaaccagtggatagattttcatgtctttccttatgttgaaaatactttgtggtagcgctggcctgttttttttaacacttgaaagagttaacttccctacaacacaagattgactctaaaattaatttttttccttatgattacagattcagaacagaagaatctaggctttaaattcttgggatcaagttctaacttatttccttataaacattgtaaacatacacaacgtaatattgacccaagggcctgttgagtaaatatttggcccagggccagtgaagtgcatgggaaattgctgcagatgggagagtggaatggaaggcagtctcagaacaggtcaagggtgtttgcttcaatcagattatgtcagtggtaggcagctgcattgagaaagttttgggaactgcctgtgacatttgcagtacccattctataaagaaaataaattcagagaggaagggaaatatgataagatggtcaaagtctgttttatggatggtagtgtcgtggcttcatcttgtgtcattggattttgttctgttttgtcttttaggatatagaatggactcacattgactacttcaataatgctatcatttgtgacctaatagaaaatgtgagtacttaggtacagttttctaaagaatgttttagtcctataattcacccttataaatgttctcagtgcctcaatgttaagcattagtattttcactgttttttatatatatatatatatatatatatacacacacacatatatatgtgtatatatatatatatacacgtacacacacacacacacacacacacacacacacatatatatatatgttaaggaactgcagagttctagagattttattgtagccctaagagatcatacacagttcttgaacacatacatagacagctggatgttttgatacttagccaggatccccagtggccatatcacaacacccttttatgaccttcagacaccaggccttaaaggtaccagcctttcttgtatggttggagcccaggtctattccatgactcctgggcatgtgagtactgatcagagtaggctctgagcagccatccagttttttgccaaatcaaaatatccatttcattcccaaaactctaatgacctcttaacatactattcaccgggtattatattaagtttaagtgacataaagggacaacctctggagctgaattaagtgggaccccagaagtggcttaagtgcagctgtagcattgattcagatcatacatgcagagggcattgcatgtgtgactgcaggtggccagggacctggaatttttcggatgacccaagtatgtgcatatgcaaaaaggcttaaagtgtgaaaaattattggataatttcgagtaagctttctgagtccaagatttttgtttttagatcatattccgtagtttattgtaaatgaattaaatgtaggaagactgattttgtgtgtggaaaacaggaaactaatttatgcttaggattactaatacctgactttgaataagtaatttgaaacagtgtataagccttattatcctgcagtctttttagcaagaccagtttagtgagatgagtgctgtgtttcaggaatacagtcacatgctctgaatgaatattaaatcattttctactcatcttttacaaagctttttgggaaatatgtaattagccagtattttttttcctcagtattcaagatattcctaaaagttgtttctctgattaaattaaacaatattctaaggcatcactatttttcaataagaaataaactgtgtttcaaaaaatctgaacaatattgaatgggaacactaatattccacataagcaattcagatctctgattttggctctgaaaagtgaatttcctgaaaattttcctggtacattttgtgaaggaggtaatttgctatgggaatcttaattttcagaatttctgattagtatgttttctttgataaatataaccttgcatttaattattctcttttaagaagaggagaaaaagaacagtggtaatacacttaatttaactagattatctcagccaaaaatccccttgctatatgattgaagaagctcatgttcacataggaacctgggtatataaaggaaatgtttccttccagcatcattaaacaataatgtttgttctggggatgttatgaacacacttgattcctgagagtccacgcttccccagggttttgtgtggaatgaataaatgctggtcagaggatgtcgtggccttgttagcagaaggggagaggaacagaggactttgcctgggtggaagtaggtggggttgatggtcagtggagtggattgtttttggaattaagacttatgaccccataggggcagtccatggagtagcagtctttatttagcaaagtagaagcttcctgacttctgattcagtttagggctgactactcttggaataaaaatgaccacagggtctagatatgcaacaaataaattttcacttatgtttaacatccatttagaaattccacatgaatttctaaaatctaaatctatatgaaacagatattcttgaaatcagtttgattgcagtgattgttaaaagcagcatctcaaatcacagcatttttttctaggaaataaactttattttgaacacatgaacaatttggaaacatagaaaacgagtttccttcttaggagtgaatcaaataatggccttagaagactgctttgtgatttgagacatgttatagaggctgtattgtcacattcatttctgcttttagatttctttttgaatctttgaggtccaacttgtctttttgtaagagtataaatttcagtcatcatcaggctaaggtgtctgaggcaactcccaggtactgttgttctgtgcgaggagagaggaaccaagaagacacactcttcccaaccacaccaccatacacacacctgggatccttcaggaaagagctgattcctgtggcttttgttattgttttgagtctctgctttttgttataactgaacagacttttcttgtgactaagttgattgtgtttgatggtgtaattaggaataattattaaaacaatatagtgaggaaggaaggaaacttttttatttccgttttcccagaacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtatgggggagctgtgagcacccagtcaggcctgccaagttacccctgcaaggaggctgtacctcagagatgggcgttcgaaaccccattaacttgtgaggacaaattgagctgctaaagtggttgaatcgataaatgttcaatagaaatagaatctggaccatgttgactaaaatcttattaatacagaaaatcaaaagcaaagctaatggacttaatgaagagtctaaatatatttttgaatcatctttattattttcaaactctaagctatcctataaaaaatatctattaacactattgaaggagatttgccagtacaaattaagagtcaataaagacttaaggctttaaaaacacaagccatttagcaaaaataatgaattatttgagattttgaaatgacattagggaaaatatttacttttttaaaacacttatttatttggttaatatttgggggaattaattttatgtctaatatataaagacaatgctaaaaacaatcttaattgattaatctttagaatcctgaaagaatattgattagagctaatacttcctttttcataaaattgcaaacttcaaagggaaaaaaacttcttgattatacatttgtaaaaagtatatagtacctgaattacctttaatttcaaaatgttagaacttggtactttattttttttattagcgtatattattaaaagataatttctgatcagcttttctgctgctcaggatatttatgaaagtgttagtattgtttctattttgccccatctacttttaaacagactagaattggtatgtgagaactaaaaaataaaagtaaaaccccagaatatgttcagactcctaaaaaatgcaaaatcctttgaaaatgttatgataacatttttggagtttattcttgcaaatcctgaatggtaatagaatttattttgatcttgtctgtgatttagacagatggaatttaaacttggaggcgaactcattatgagagtgtgactaacatgtcagggattttttgatggtgaaggaagtggctgcaatgtagatagtcttggagtatttttaatagttgtttgacattatagcatgcaatgtgcctgtcattgagttacatgtgctgcttataggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtatttttggcacatgaaactttcacagttcaaatgtgagagcaccccgaaggaatatcatttttccctttgcttcaatctgagtgtagcccaagcagagggtaactaaaatacttacagattaaataataccttatctgggattggcttaaaaaatgctccactatcctttcccctaaaataagaaagtaaaaaagtaaagtgtggtggagaagatagtagatatttaatgaaactcagtggttgagacctaggggttttcaactttctgtatgtttattattatttttttaatggcaagttaaaaaacaaaatgcaagtgttttttctggtcagtgttttgcagaaaactcttgttggcttcatttgggattcttgttctattagcttagagcacagcattgaagcaagtgctttagttaactgctctggcacttcttaggagacatgcacttttttcttccctgtgagaggtgtaggcctggagaaagtaatgattcctaaagcaatctgaatttttttcaaggcagtagaaagaccttcttaaaaagggctgggcgtggtggctcacacctataatcccaacacttagggaggcggaggcaggtggatcacctcaggtcaggaattcgagactagcctggccaacatggcaaaaccctgtctctactaaaaatataaaaattagctgggcgtggtggcaggaacctataatcccaactacttgggaggctgaggcaggagaatcgcttggaggcagaggttgcagtgagccgaggtcacgccactgcactccagcccgggtgacaatacaagactccatctcaaaaaaaaaaaaaaaaggaaaaagccttctgggctcttctctttttctgcttctagggcatcttagacagaactctctctagatttagtaaagaccaactaggattagagtttgctatgtgtgtatttggtgagctagatagtagaaggtatgtgtctggtgggtcagatttcatagagcacacccatacccacaagtaccttctatagttgtctttgaaaatgcagttatgaggaaactagagtgaagaatatttttgtgtttagtttgtgtgcctgatatttatatttacagaaatgtaagtagacaaaaccctctggtttgattgcagtcagattagaacatatgttggagaggatcctagtttaaaaaaaaacccaagaaactttctgtgatgagttgcttttgttattctcaattgaatgaattttttttttgcatcttaactctattttattgaggtatcatttatgtgaagtgatatgcacagatctgaagtgaacagttcaatttttttttaaccattatatatgctttagtaaccaccacccaggttaagacgtaaaacatttccattaccccagaaagcttcttcattcccctcctttttttatttttacagcttttctaagaaatcttaattaataaaccccaaggttgtgaatatattatcgtatattttcttctagaagctttatagtttcagatttcatatttaggtctgtttcccccccatgtagatatcctgttgcactaataccatattgaaaacagtcttcttttcccattgatttgctttgtggcctttattgataatctgttgaatgtatatgtagggatctgaacttactaggccattccatttatctatttgtccatctttatttaagccaaagagtagacattatttttataaatggtaaaagagaaagcatagtaacactgatgccaaactagctaagatgtagttgtccacgtaagtgtgtaatttcacagttgtagttaggcagccataatcatgaatgtttaagtattagttaggacacagggattgctgcagtatgatccaaagctagcaatgatttaagcaagattgatgtttatttcttaagtaacttctaagtatgaggactccagagctgacagggcagctccttctgttttgtggctctgccgtttcctgggcgtgttcctcgtctgcatggaggaagatggctgtccaccgtgtcaacatttgcagccagcagtaagctggaggagacgaaggggagtgcctgtcccttcttctaagaacactgactagaggctgcagacattacttcccctctgatcctagtggccagaagttgctcacctggccacatctacttgcaaaggaggttgggaaataaagtttttccctgggcagcaaagtgccctgttaagaaaggagaacagatatagggaggaaacagtgttttttatctttttattgaggtataatacacatacattaaagtgcatggatcttaactgtacagcttcttgaagttttacagatgtatgtacttgtgttaccccatccagaccaagtggtaaaacattcccgtcagtccagaagattcccttgtgtcccttgcatgttgatcccccactactacctctccccagaggtaacagcaatactgatttttaaccatgggttagttttgcttgaacttgatataaatggaatcataactacagcatgtactcttgtgttgggcttcttttcactcaatgaaatgtcagtgatacttatccacattattgcatttattagtgtgttctttttaaaattactgtgcctgcagtattgtatttatttttaggtggttataaaatgatttgaaataatttcaaaagtaatgactaggtttcttaagaataacataattgttttgctatgaaacagttatatataatactttgtgaaaacatagacaattatatccataggaggcagtttataacctaaaatctttgtgatctttaaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtaagaaattcagtgaccatatttaataatgaatgttttaagtggtcaaataatacggtgttttttcacatgctgttagataaaacagaattttatgaaaaactggatgtaacctctgttttggaccttcttccattaggataccattttgtgctaaggtcaaaataagacttaccaaatccacatttgggacttgtatggcaataatattaatttttagaatatgcccaaggtaggttcgtaggaggtggtttgtaatttgatacacttatatttgtgtagaatcatagaagggtagaattagagacaggttggattaccacttgtcacttttcccatgaagaatttggctgcagagagaatcagtggatgggtgaaggtccctctctttgcctatatctataccagttaatcaatagacgatacgagcaggtaggattcacagtgtcagcattactgctaggagagctggattagagaacgtagcttggacccagggccatacagctttcagctggtctgtcctgaattgcatttactcatccagtcccagacagagtgctggacaccgcaggcccagtggtgcatccccatgtcctgtgagctctccacaggcagagagaactgtgtactgacgggcggctgttgcaggagagaaatcaagccttattccttctgccctcaccagagaggctgctcctctgcaggctgaagaaggcttgcccctgaatactgctggagggctgacatgcctgtttcatgggcctaggcaggaaatgggcgattttcatttaactgtactggtattgcctacacattattctcactgcacctggcctttcacaggaacatcaacacacctaggacacttaccttgtattataagaagatctagaaactccagatgtatggtgcggtctctgatgcctaatttagtaccctaatttaatgtaggatttgggtactgtttcagttcccattgctaatttccggggtattatggtaaacaggtaccataatacagaatgtgtattcactccctgcctggcatctagtctgcaggtgggtggagtgaggtttagttctaaagactgatgttgaaaccggggtccaggatggagaggtcagggccaagtccagttcttgctcccgctgggtaaggcccacgttccttagcgtcccgttggtctgggactgtttcttggtctctgcttttattctcaggggcagaaacaatgtttaaaatattttcaggaattaactgagtgagtttaaaatagatctgaatttcttgcacaccctcctggcccaggttggtacatcattataggtatttttgatacaagtattgcctctactaatgaaatcaagaaattggctttaataccacattttcttagaatacatagttatgaacccaaatttactttttcagtgtttactggattaagtttaatttgtggaaaattctttgataaatggatgattgctgaaagagcaattacacttggaaatgaagctatgttttataccactgagaacctgataccatgatagaagataaaactatttttgtaactcagaaaactcactgtttttatttttatttttttaggtctggtgtggaggtcctatttaatgaattagaaattcccgtggaagaatactcctttggtagatcaaagatattcatccgaaacccaagaacagtatgtaacgaaaacctttacactctgaacttaagttggaatcgtataggaaagttcttaaaatatgtttaactttataacattatatgaggggccaccatgaatgccacaaaacacttgtgtgtttatctacaaataatcaagaggcagggacagataagggtaaggggcggtagaagaatgcgtattttttatgaaccatcaaagtctttgctctgacagattgtacaacacttaagaaatcacaaagaaactgttaggacaacggtgcaacattcatagcaactgcaggtaaacagtctgtatttgtaatacctgaattatacattaattttaagaactacagccccattatttagaggtacaggaaagcactaaaatgaaaattttttttaagttaaaaaaaatacttttagcattctacctcatagaaccccaaggaaatttttttgtcaatgaatagatgagtgtgaagtgtaatgagtatagcaggtgactggtaatttggaaacgttaagattttggaaagtatttaattcatttaagagaattttccagcatctaccttccattagtaatttgcatcctcatagacagtgtgaaggtaaacttaaggtcaattcagcccctctctgatttgtcataaattctgaatcactggaataaaaattgtaagtctttcatgaatccatcaaaataattttctcatggaccattatccatatcatatataatgcatatggtttttcagttctttttttcaatgtaattgactccaacatgatggcattttgtctcctgaaaattcctttcctgtatgctgtgaggtttcagaggatttttgataagtccatctatcatttcttattagttattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcggtaagagtctcagtcattttaaatcagtaataacaatgctaatttgccaacatttattatgtacttaccatgtatgtgatttttacatacttaattctcccaacaacctcatgagataatggatgttcttaatggttcttttttttaaagatgagaaaactaagacacaaagctgttaagtaatttgcccacagccacatagctataagtggtagagctgggatttgaatccaagacagtattagagctcaagttcagtgtgccataccgcctttcactgatctagctgtatttggttggaaatacatttttaatttggtcatcagattggaagagacaatatcctttaagcttttgatttggttgggctagtttttcaaagtaattggctattctttggctattctttattgtagcagctttgaaagtggctttaattccagaaagctaatgccatgtttttgtagatttctggttttggttaaaggattgcattctctttagtccttaggtatctggctctattaactatagggaaagattcaataataaataatgtttacctagttaatatgaaatttctttttggcatttccttcctcatttgattgtagagattttgttgaaggcataccacaggtatgagagaagcctgaaggtttgcctcagggttaattgaaacttgggctgtgttctcacaaaatgaattaagtttgcactcacatctcctttcttatattcttcctctttttcagccataaagagactttgctatagggctgtatataatcaagacataatttacgctgacctattctcacataatacattttagtttattatttccaagttttacaaattaatgaggtatttaattgattaagctaaagaaaatcagcttgagagtatctttacaatggctcatgctagttaagattataaccagcagtataagtcttaaaatatgagtctgcccagccatgtgaatgatagagtcattcatatgcattctgcagaggcactttggactgttgtcacccagcctggtggccgtggagtctcctctgtacacatagtaccactccttaactctgctgcagattcataatgctccgttttctgttagcctgagaaagggaggaccaacaagaggaccaaaaagtcctcaaggagccctttttataatttcttattttgaggtcattaagaaaagtttacaagtgtgctggattcatctgtcttgaattctacaaatatttttgaaacacattagcaaggtggacaaaacaacctaattcctgacttcctaaagtttatatctagtgaaagacaatacgcatttaagcaaacaaataatcagaaaaattatagactgttgtaagtgctaggaaggaaatagagaactgccataaagaataatggggaggcgggatgtgacctaagctagagtggtcaaggagaaacttcggggaggggccatttgatcggaaggatgagaaagaacaggcaatgcaaaggaagctcaagtactatttgtaccttttctcccaatataaagcttttatatcatcagattttaaaaagtcacgatttatcattagttcatgatgtcaggagttatgagcaatattagttggtagaatgaaaactaataatagccccagttttagagaatgcattaactttgttctaatgttacatctctttcaaaatttgaactacatacctcaaccagttcactacatgttactcaagccagtggttaaactcattattttccctcaaccagataactcaaaagatttcttgaatgctcctttttagttgctgattacttttaagttattccgtattttgtaatatttcatgtttcctagagatgaattttcaagtgagatatacttattttcaagacatttattaattaaaaaggaaaacacagaggtaccaaatgcgtgtcagaatgatggtcagatactgtagctgttctacagctacatctgtggaatattactctggggagaatcctagagattttccacctcttcatttaacagctggggaaactgaggcccagagaaggtgagtggcttgtctgaggtcccagggtcctcttggattttctccctggcatccttttttgttcctctgcccatctattgataccatcacccattacctctgatcttccaagacatagcctggtagcctgggaaggcatctctcccgcctcagagaaggggggctgagccagctggcacttctaacatgagggattcacaatgtgactttagtacttcgaaatgctgtgaattttcattagggatgcccccatgtttcagtgtatattccaaagtgaatactgtaaaagctcacttttctagggagtattccagcagcctccactccagggcgtcagccctagaagtaagaaaggcctctgggcattgagcttgttgagccagagctgggagcctcactaggtcttctttgaccttccccacctggaagtaacctctgctgcctctgagcctgactgttgtgctttctgtgctgcatctctcccagggtactgtttatcctttatactgttgacctgtgttcacttcaactccttgagggcagggatgcagtcagatgcacatttatatcctcatggtcctattaaaaggctttatgcatagtagaggctcaatatataaatatttaattgattgatagcagtttacttaaatttttagctgattttccagcttgaggcagagtaaaagtagcaaacctaaaagaaactagggaggtttagaggtgggtccagtaagtagcatggtgagaaatgacaccaagaagagagaacactcaaaagcagatgcagaactcagtgggttttcattcaatatgcatttactgagtatctgccttgtgtggaaccctgtattataacagcatgagatgaagaaaataatgataataatgctgtgtcctgagtcatttaggaattattttatttagcatccttaaagcatactttggattaactgtaataatattggattgtttgatattttggtttctttatgtattggtttccagaaggagtatggataattgagtcagttagacgaagtgagcaaataccctttctcaatccttgtatgcgttacagatattaactacaactgccaatatcttccccttttatcctacagcaacaaaagaggtaccagcagacaaagagttccgccttagtaattcagtcttatatccggggttggaaggtgagtttaaaagaagtatgctttatttattttgggttttctggtttttcacaaaggataatgtctttagggtcaccctgcagaggaggggctcctctgtctcctgcctcgcctgtaaacagtcagatggaaagaataaatattatgggccaaacggggaccctggtgaccatgtcttggccacttccttctaaccagctttctttttaagcgctttgttctctaagcaggaagtccttgaaataatacccgtacatgatttcagtatccctttgccccgtgttttcgagaaaagctgtggtacagaaggctatctcacagccattgctttcatactcagaatccctaccccagtgacttccgtaactgtccagtaaccatcttgcaggctacccatcacgattgaaagatcctgagatctggccaggtctagtggtggggacatggaggagccgtcacagtggacagcctggttctaggtccttgctgccaaggcttggttcaagggtcactgaactacaggccacaggctacagctagcctgcttgcgtgttctcatacaacctgcaagctaagaatggtttttatatttttaaccgttgtttttaaaaaagcaaaagaagatgatttctttttttttttttttttttttttttttttgtaggtgggatgtattttttttattttttattttattttatttatttttttttaattgaccattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgacttcaagcatctgtttaacaaagcacatcttgcaccgcccttaatccatttaaccctgagtggacacagcacacgtttcagagagcacagggttagggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcgtctggccgggcggggggctgaccaccccaccaccctcccagacggggcggctggccaggcagaggggctcctcacttcccagtaggggcggccgggcagaggcgcccctcacctcccggacagggcggctggccgggcgggccgacccccccacctccctcccggacggggcggctggccgggcagaggggtcctcacttcccagtaggggcggccgggcagaggcgcccctcacctcccggacggggcggccggctggagacggctaacccccccatctccctcacggacggggcggatggccgggcagaggggctcctcacttcccagtaggggcggccgggcagaggcgcccctcacctccggacggggcggctggccaggcggggggctgatccccccaccatcctcccggatggggcggctggccgggcagggggctgaccccccctcccccctcccggacggggcggctggccgggcggggggctgaccccccacctccctcctgggctgggcggctggccgggcaggggggctcctcacttcccagtaggggcggctgggcagaggagcccctcacctcccggacggggcggctggccgggcggggggctgacccccccccacctccctcccggacggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggcgctccccactcagatgatgggcgggtcaggcagagatgctcctcacttcctagatgggatggcggcggggaagaggcgctcctcgcttcctagatgggatggcggccgggcagagacgctcctcactttccagactgggcagccaggcagaggggctcctcacctcccagacgatgggcggccaggcagagacgctcctcacttcccagacggggtggcggccgggcagaggctgtaatctcggctctttgggaggccaaggcaggcggctgggaggtgtaggttgtagtgagctgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaacgaaaaccagtcaggcgtggcggcacgcacctgcaatcgcaggcactcggcaggctgaggcaggagaatcaggcagggaggttgcagtgagctgagatggcagcagtaccatccagctttggctcggcatcagagggagaccgtggaaggagaccgtggggagagggagagggagagggagagggagagggagagggagagggaggaagatgatttcatgacatatgaaaagtatatggaatagagatttcagtgtacataaataaagttttattggaacacagccacattcatttatttcacagattgtctggctgctgtagcactacagtggtagagtcaagtagtagcgatagactgtgtgaccttcagagccaaaagcagttaccatctggcattttacagaaaaagtttactgatccctgatctaggtcaacgatacttcagagcctgttctgaccactttcctgtgaggagactttgtggtatggtctggatccagaggggtagtgcccaggcctggagccctttcagagggtagacgctgggtcccgagtccagcaacactgactgaccttgcccaggccctcgacaacttaagggcttagcagttgtctcacagcaaatggcaaaacacaaatctgaacatgtagagtaagtgaaactgctgcctgcaggctcttccttggcctcatggctggaccttggggccccgtttataggcgagagaccttagaggaaggacccaaagtccaccttgaaaccaggtgtcctcctggcccccataaaatcagtttccagcaactaatggaaagaagtcactggtttgggatcaatgagatcattttggttttggagttttaaaaatatcttgaataaaaaggacagctacagttacattccaggcaataataatgaaagagatacagtggcctttagaggatcattggaatcctctggcccctttctgagaactgtttcatcccacagatgtgtgccagcttgtggtgctgtagtcagatttttcccattgtgtatcagggtacgggaggctgctgttccaatcaagtggaaacccatgcttaatgatgtcttcattgtccaccttctcatagtcagtttggggctagtcaccttcgccttctttaacctgttgatttatcacaatagcatgggtgttaggacgatcatctcttcaggtttttttttcaagtcactgtcaattcctttatttttaaacattctctcttttgggtgattctgccctttaggctcgaaaaattctgcgggaactgaagcatcaaaagcgctgtaaggaagcagtcacgaccattgctgcatattggcatgggacccaggtaggcccgagaccccaaggaaggcggtgggtcagcagtaacgtcatgtggaaccatgaaccctcggcttcaggggcagaaaatgtttcactggcttgagctactgagcacgtgtttgcttcttgctctttccaacattttgttgtggggtggtggcacatgcttttgcgtttaccatttggtggtgactagtgtctctctttttctttcttcattgaaaaccagcagtaacctttcctgccttaaacttttctgtaactccttttcaaatgcatcacaggcacgaagggaactgagacggctgaaggaggaggctaggaataaacatgctattgcagttatttgggcttactggcttggatctaaggtacttgatgcacatatcccaacactccatcctggaattctgcaataatcagtccttacctctagcctattaggggatgaatgactacaattaatagtggctcacactggtgcatgtcctagccgccagatttaacacacctggaaacattagttcagtagtatgcataggaagcttaggcatgcataggtcaataaaactaattgcttactaaaaaggcactagtatcattgctctttaaaacaaaacaaaacaaaacaactcttaaataacatgcatgtttaggttcccccccgcccccattgatgaatgctagcagttttttagaggttttctggaggggttgcgcatgttgggaatgttcaagtttgggcttcagtcggtcttctgcaacatgttgacaatggaaatgcctctaacatatgtcttaaaaatattaatttatgaatgaaatttttttttaggctcagtgtggcagctattgattattataagcaaaatattacatgtgcaaagaattatcatctgtgatttaacagaaaactatgttcatgcacagctagctatgattgccactgaagaatcccaggaatttcagcatcagctgtttgttttcagaaacaaaggcctcctgaaatactctcactaatccccaggcatagtcgtgggctctgtgaacatttcacataccccaagggacaagatttttagatgtttttgttacttagaaaatcaaagtcatctttgctaaaaatgtgtattccagttagaaacacaaacatcaacagagtcctgtgttttgaagtccaccttgtcaatgttgtaagcctatcttatgagaaaatgagaaaagtcaacatctgcctgcataaagagctaatttgccaaaaactaaccagagttgttcatctgtgcttttcctgaaaatctgtgaagaacaaacttgttcctctagtcaactgagggaaatgtcatagcagaagcaaaaggactcttaggtgggtcttgctaagatttctccatccagtgagttcatttcccagtctcagtactataatatcttgaacaatcagtgcctatttgtatcctttagaatagcttgcctaagattattttttccctaagagtaatttttaaacctataagtttaacctataattgcttcagtcttcctgtatattttacttttgcgaccttagctaaaattgaatttttacacgtgccagttttcattttttgactggaaggaatttttgagttttgttagttttggtttttgtttgcacttcagagaaataaacttttttcctcccagttttctaagtgattgttcacaagagttgtctttttatccatccaaagggatgaactcaggagtgcatagcttcttcagcccaatgtgctgtcagcaaaggggagtctaatgacatcattagggctgttactcagagtttgaaggctttgatatgggagtgaaagagtgtggagaaggcagcgaacagagagagagaacaggagaaaaaaggaaaggaatggaagtgaggggtgggaaatgattaccttgggaaccacacagattgtccttctctggaacagaatctcagtgcactgaaaatataagcgctgcaccagcctgacaccaattctttgggtttaaattgttatgcactgttcctctgtcattctgaaatccttattcataaattggctcttctgtttggtgggatatctttttctggtcatttgtgctgtctgcattgggctgtctcttttatttactatctaaaacattctaggctcgaagggaattgaaacgcttgaaggaggaggctaggcgtaagcatgcagttgctgtcatttgggcttactggcttggactgaaggtacttcctcaaccacttgtttctgtccagggtgaacttcataaagcctagcacctactaaccctgagaaaatgattgattatgcttgctgatggtctgcacagtcttgtagaatgtcatcttgcttaattttgtacctttttcagaagaaacctatacactaatttttttctgattttgtgatttctatttctttaaataataggtttaatgtaatagcaatatggcatgttttattcaagatactatgttatcaaagttctagtttgttatctttatgagtgtaaagttgtttttttaaaatctgtgagacacagttacaatagttgagctaaaagctgccctacatccacagtgaccagcctagggatgccaggcttttgtttccctttttgtaccaattctgctccaataatggctgcctgcagtagagctttcttcagagcgaccattgttctaattgttcagcgttggaaccaaagggtcttgcatcattaagcttacagattttgatgaatgagttcagagattcagagatcagtggatcattcatgttaaagagaacctcgaattcaaataccttgtgattatggcagggtttattttgaagtggtgcttactacagtagggtacacttatgtgtacagaactacacataagtaaataactctgagctctgagaagcccttagaatattctttacaccatgtaaggatctgatcttccaaattcaataattagtcaccataggaagccatccatattgcctttttgggataattaggcccctttctgacagtattccttatcattgtttttactttaatcctatgacatttaatcttactccaaatatttgaattattatctgagtaatcattgactctaagtctgaacaaccattagaaatatccctgaatcctgctttgaacaatctgcattttttttctgcaatttcagcctataaactttagtaaattatcctttttgattatactgaatattcaccaagtaatatttgaagtaattaagaagtaacttaaatatgaattttaacagatgttctatttgaagaactccaaacaagctctataaccggtttttttaagtcaaacaaaagtaaacattttcccatttaactcacatctttagttttctgggtttaactgcatatgatttcaaaacatttttgcattaggggtgtacactagcaacctacaaagcaaattcagtttgtaggggaatattattttagcagaagttaactgggcttactctagacataacttttttcctctcagtctccaacaaaacagaggtactttactatataaccagtattattgtatgaaataagatcaaacttacttgaagtccaagaatataataattttgtactttttttttctaaaagagaatcatgttaatatgaatgataattttgccctctcaaatgattgacttttcctgtggaaataattacaaagtgcagtgggcctttttaagactcccagttccccagggggcaccatcgtatatgccagcatgttgtcaccaggcttttagtgtctgtagtggtattttgggagaaataacctgccctgtcgaatatcaaaatgcatatagcaatgagctcagttatgaggctcaactaaatatcgtatgacttcaggtatatttttaatgatatattcttatgtaacttcatttgtctgctttcctatactattataatttcaggagccaattattaggtaacatttttcttctccttgtcccttctcaccttagtttgagattagaaatgtttgtggatctgacagctctgtggctaaaagacagatgataatcagtaactagaatatgaatacaggcatacctcagagatattgcaggctcagttccagatctctgcaataaagtgaatatcacaataaagtgaatcacacaaatgttttgtttgccagtgcaaataaaagttatgtttacactgtctctactgtagtctattaagtatctaatagccttatgtctaaaaagccaaagtacatactttacaaatacttcattgctaaaaaatgctaaccatcatctgagccttcagcaagttgtaatctttttgctggtggagagtcttggcttatcttgatgtcgatggctgctgactgatgagggtggtggctgctgaaggttgtggtggctgtggcaatttcttaaaataagataacaatgaaatttgccacatagattgacttcctttcctgaaagatttctgtatagcatatgttggcatttgatagcattttacccagtgtagaacttctttcaaaattgaaatgaatcctctcaaaccttgccactggttttgtcaactaagcttatggaatattccaaatcctttgttgtcatttcagcagtgttcacagcatcttcatcaggagtagattccatctcaggaaactactttatttggtcatccataagaagcaactccttgttcatttccatcttatcttgagattgcagcaattcagtcccatcttcaggtttcacttctaattctagttgttactatatctgccacatctgcagttacttcctccactaaagttgtgagccccctccaagtcatccatgagagttggaatcaacttcttccaaacttctattaatgtggctgttttgacctcctcccatgaatctggaatattcttaatggcatccagactgatgactcttttctggaaagtttttaatttactttgcccagatccaccagaggaatcactgtctatggcaggtatagccttataaaatgtatttcttaaatcataagactgggaattactccttgatccatgagctgcagaatggatgttgtgttagcaggcatgaaaacattaatctcctcgtatatctccatcagagctcttgggtgaccaggtgccttgtcagtgtgcatgaatattttgaaagttctctcttttctgagcagtaggtctcaatatggggcttaagatagtcagtaaaccatgctgtaagcagatgtgctgtcatccaggctttgttgttccatttatggagcacacaggcggagtagatttagcataattcctaagctgtaggatttttataatggtaaatgagcattagctccaacttaaagttagcagctgtattattctttaacaagagaatcaacctgtcctttgaagccagacattagcttttcctctctagctatgaaagtctagatggcatcttcttccaatagcaggctgttttgtctacattggaaatctgttgtcgagtgtagccacattcatgagtgatctagttagatcttctggataactttctgcagcttctctatcagcacttgctgcttctttccttaaccttcatgaaaagttaataaacttttcttctgcagcttcctcacctctctcagccttcttggaactgaagagagttaggacattgctctggattaggcattgcttagaggatattgtggctggtttgatcttatatctagaccactaaaattttctccttatcagcaatgaagctgtttcacttccttatcatttgtatgttcactggaataacacttttaatttccttcaagaatgtttcctttgcatttataacttggctgtttggcacaagggtcctagcttttggcctgcctcagctgttgacatgccttcctcactaagcttaatcatttctagctttcaatttaaagtaagaagtgtgtgacccttcctttcagttgaacactgagaagccattgtaggattattaattcaatattaattaatttctatattgctctgtcttagggaataagggaggcccgaggagagggagagagatgggagaatggccaatgggtggagcagtcagaatacacacactgtctcttgattaagttcaccatcttacagatagaaaaataatgaaaaagtttgaaatattgtgagaattatcaaaatgtgacagacacagaatgagcacatgctgttggaaaaatggtgccaataggcttgtttgatgcagggttgccacaaaccttcaatttgtaaaaactcaatgtctgcaaagtgcattaaaatgaggtatgcctgtaaaaagaaaaactgcctataaggtatatgttacagtttttaaaccttaacagtctttagaggtagagaatgggtctggtgcaaaaatgctcagagggaccaggttggtcgtacagatgaggaaagcatcagatgggaggtggatcagaagcaaagggactcgtgtagtttggagcgtgcatgcctcatctaaaggcaacagcagctactttggtctccctggcacttattttataggactaggcctcagtgttgctagatcttagacaactttaagagaaatctgcagtctgaattgttatattgagttcttaacttaaaaatatgcatacagaacatttatctgtaaactgaatttggatagaagattactagcttacatcccgtaatgtagaaatattttgaacatgtgcagttaaacctagaaaactagaaagaaaagaaaaaagatatgtaatatctgaattattcagataggctaatattttgctaaattctaactctcccatttgtatctggatggtaataaatacttaagatatttttccttcaatttcaaaatttaactatataatttattcatttgttatacaaacactccactttgttactgttatttgttagacattagtatatgaagtaaatataacaatgtagcaaggaaaaaatgtgtgaactaaaactataatatgatgttttaagtgctctgatagcattaagtataaagtttggtgggagtagagatgatagagaagaattaatgcaatgaaatggaagataatggtagtttcaaagcttctatttaaattcttagccatattcagttctcagtgtgtaggccttatcttctatgcaaggcttttggaaactgatacagttcttcagactttttttttctttttgccttttacaaaacaatctgaagagaacattattttatataatttttaatgtattttaattggggatgagtttgcagctgtgcctgtaaaatgtttcttgtcaaatcatcagattcttcaaaaactactaagaggatttaaaacatcaattcatgctggtttcatcattttacatttcttaatttctttctctctgacttaagatccactatatgaatgtgtttcaattattttactaaatctagaaaggacacttataaactgacttgtttgacattttttcatttttaatagaggtgtatcattatggacctgtaccagccacacattaaccactgtaacctacatcttctttttaaaggtacgtagagaatacaggaaattcttcagagccaatgctggaaagaaaatctatgagtttacgcttcagagaattgtaagttgacactttatatctgtggataatcagcattgtggaattacccacctaatatcaccaactccataaaatgtgccttttcctaaatgacaaaagtgactttttaaataataattaaatcatagctgtgacactgagagttagttatcttttaaaatcatcttcttccaaattctggtagaattgtgtcagaaagagttgttaatggcccgtatattattaatacagtgtttgccttatttgacaagagagaacttttgggggaaagtggatccaagaaagccatgactttaccctgtgaaactgccatgagctgtggcagggcaaggctggcaagcaaattagtggggagaggggtgacagggagccaggctgtgcagctccacccacatggactctggagttctccatctttcagagaggtgtatgtagtgctgaacagactgcaaactctggagccagcccccactgccacttagtgtgactaaggaactggattttaaaatttaatttaattttagttacttaaaatgtaaatataaatagcctgtgtgactagtggctgcattttagacaatacagctctatagagctagctggtattagcattagtgttaatatgagtgttagcattactattcttcttttctcttaaccatttggtagaactcatatttccccaaccagtatgaaagagtggagtagagacttcccagatgagttacagttctataaattccaaagttaaataaattctactattgtctcgtttatttgatcatgatgtatgtaaaacagtgtcttttgtggtatattttcctcatgtagtattttctgtcaacccaacacaggtgcaaaaatacttcttggaaatgaaaaataagatgccttccttatctccaatagacaagaattggccctcaagaccttacttattcttggattctactcacaaggagctaaaaaggattttccacttgtggagggtaaaaaatgtcatattacatcttttcggagactttcttatttattttgagtgtttaaaaacacataaaatcaaaactgttaacacattcttcctttgcctcaaagaggattacttgaggactttggtgattttcccccatgcaccatattgagtttctacgagagcccctgcagcggcccaggcgttccctgtgcggtcgcctctcggccctggctggaacggggagcacagggctgcattttctttccattccaggttccagctgctctcaagtagttcagttttttgttcatttgtttctctctttgtctaaaggaatactgtaggacagagaaatcataaaatttggacaccttcaggcaacatagttaaatcctgcaaattgaagagtttactttatcagatgtacagaacagataatcagataatacatgtgaacacacacactttgatgggtgggaaaaaaggctttttcctgtccctaaagatagtaacacattctctatctaaattacagggaagctggaaatctgttttatactgccttttattttagctctcttattttgtataagaggacatggcatgtaatttagatgttgcccagcatggaacacgtggggcacttgtatagatgttgaccttacttcgataacctagtcagttgatatgtggaatgttaaatatatgcagttatcagatgtaataaaatcatgagatggaagggcatgtatttagtaaatgaatgctcagtacacacatcctccaggaaactttcctgcccagcacggtgggcttgtttttttgttagaatcatctatgtatagagtgacattattgctgattagcttgataagtggtaccatacaacataaggaactagattctgagttctgttctctaacagcaaatttggcgaggttcatgaacctcttaatggcttgtctcctttcttgagtctaacccagaaactgttttcagaaataatgacagggagctcccattgctggggatctgcaccacctctgccctcccctggctttgcaatctcacccatccctccattggattggaggtgggagatgagggctgtttattcctgaagggagcctttccatggaaagggtcagcagcaatgctcacacttcttcatgcaattatttcagtagcacttgaccacacctgtaactgaatttctaggaatgctcatctaaaaaacctggccctgctcctctggccactgtctcctctcattgcagcttcagggatggagtgaaaggggatatctcaggtccctcatccctattgtaaaatggtagtggggggatttggagcagtggttttcaaactgtcatagcatatttgtggtcatgaaatcaatttagtggattactaccagcgtttttcaataaaatgcaatagaatagaaaatagcagagtgtacaatatatagaaaggattgagtattgttttgtgacgcttttgtgtcagttttctctgtatgtgtgtggaaatgtgcttagtggattgtgatgcacaatatttttactgtgagtctctctagaagagtgacagcctcaggactagaggatttccaaggattgacatagtgggaggaaatagtacttgcaaggcccgtgcccactaggccctggtgtgttttgaagaagcattccaggttctgcaatacaaataatactctgacgttttccaagacaaactttttaaaacccacaagggaaaaatgtttttggccttttttagtgaatgttttgtactttctcccttattcttgttgctgataaattgtcttagcatatttaagaatgagtaataatttatttatataaatgatgttttgtttctttcttctcatatctcacagtgtaaaaaatacagggaccaattcacagaccagcagaaacttatttatgaagagaaactagaagccagtgaactcttcaaagacaagaaggctttatacccatctaggtattatggctttgctttacccataaaattcaggattataaaagtttctcaagtatatttgtacgccgttttgcctggtgtttgatttcagtcttagatgagtgatttttagttctgtgaatcattttataatcagcttgatgtaaacacatttatttgagctatggcttctatagtgcagtttaatgaaatgaggttacgattgttggtttcactccattagcattagctcaaacactttactaaataattagaagtcatttaacataaaaattatataggctgttaagatacgtttgcattgtaaattcctgttccttttccgtagttttcaaagactagccaaatttctgttggcaatatactttaatcaccattccagtcttcctgccatagcaagcaaggtcagaaacttatttgtaaggtaaatgaaagagcgagccaggacagtactttttgagtgttgcttgagcactggtctgtggtgccctttggtctgctaactcaacggatatgacttctgtggcctgtacagcacgttcagttcctttattttagacaccgtggactcagaaaaagaaggaacaccaatcccaagttcagcaagtgaagtccttggtaaagactgtttatcccaatagtcttacatctcctgcattcatcacttcctcccagcaatctaatcccattttcatctggtgtttataaaaaagtagattgtacaatttcaagccaaatctgtaacaactttaagcttcttccaatgaatggccaaagaaagaatgtattatatgctgagtatattcacatttattacgtaaattatgtttatattctctgtgactttatacacatttaaaatatcttccttttaaaggattaaaggaatatacattgccagactcactgggtttaaatattttaaattgtacaacttcattggttagctgatgtggctacttgaggtgatacatactcccttaagtcaaacacagtgtctaaatccaaagttgtccaaagtgcctgttatataaagcatattcaaacaggagaatttgtctgtatgcttgcttcagcaactaattttattcagctttttttttatacatttttaaattagggaataaccttcttaatgaacatttcctgtggatgactcttcagaaactacaggctggaaaatacatctttgaggaaacaatttaaaagcctgttagcatttttataatttaaaacacagttgaataggaaccaaaaaaagttaacttcaagccaagtcctttttgggtagtcttatcagttttcagggatagtggcacactcaccccacagcagtgagagaggtggaataatttagcctcccaccaccctgcaaagtggcagctcttatgggagttggccttttatatcctgagagctgtgaaacgctgaccacctacgtggatttttcttcccttatcctccacccacaacataagcatttaaatttgtatttgcaaattgccagaactttgtagctcaaaatgaagcttatagattccttgaagcagcagtttttccttggtgcctttgatgaacctgtcctgaaagagtcccccgacaagtctttagggaaattgatatcttagtgataagtgtacagttaaccttttacaaaaattagtttgtttgggaaaaaaaaaattgccctgattctgaatgtttgctttggttacttctgtccatttagaggcatattctaggagaagaggcttgattctcctttcatatacagatgctgcttaacttatgatgcagttacacacagataatccatcatatgggttatgagtgatttctatcttgattgttccatgtgatgagattattatcaaagtcctgcccaccaaatgccatgatcacctcaaaaatatatttgaaataggtttaaggtttcatttccaacttatatttaggacagatgcaagcgtaatgtataaaataaattgaagtcaatttttatgaagttgtcatatgtcatatgaagttgaaaatatcataagttgaaaatgcatttaatacacctaacctactgaacacaatcacttagcctagcctaccttaaacatgctcagcacacttacattagcctacagttgggcaaaatcatctaacacaaagcctgttttataataaagtgttggatatctcatgtggtttattgaccactgtactgaaagtgaaaaacagaatggtttatgagcaccactgtaaagctgaaaaaccctaagtcaaaccaagtcagagaccatctgtattgcctacttagaaccacagttacatgttaatattaagtgttctatagttttcttctaaagtgattgccctggatctgttctttcccagaaggcctattgattttcttattctctgcaagaaatgaaatttttctttagagcaggtgatggtaatgatttcagctcttttcactgccacatattgtttgaaggcgttagtaaatcctttgtgagcagctgttaactttatattaacagattagaagaaattgccttttccttcacatgaggccatgtacttgagtcttagctgttgttcttatgagtgatttctgtcttgattgttccgtgtgataagattattatcaaagtcctgcccaccaaatgccatgatcaccccaaaagtgtatttgaaataggtttaaggtttcatttccaacttatatttaggacagatgtaagtgtaatatataaaataaattgaaatcaatttttatgaagttgtcagctactccttagaatcaactgacctgtttcctttttttagtggtactttcatttgaaactatttctaatgtgcaggaatttttttcctttagtgttgggcaaccattccaaggggcttacctggaaatcaacaagaaccccaagtataagaaactcaaagatgccattgaagaaaagatcatcattgctgaagtcgtgaacaaaattaaccgtgctaatgggaaggtaaaaatgctaaccttgaagactgataagaagtacctattagttgggatagtcaccctgttttctgaatgtaaaaatttgcatttcatgttctcagtagagttaactatgaaggcggctatttccccttacctttaagcttaggtggaattttgcttgttctctgacatttttatgaaataaaacatattatttatgttctttactgcgttcttggtttacataggtatgtttgttgaaggatattggaatttttgcaaataatgccttaaactcatggaccatttttgagtatttgtgatcattggttttatactattttttattttgatttagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagaggtaaaggttcaacagaagatttctgtgcttaatctctcagccattgatttaaaaaatttccatatctgataatcctatcgcagtttatatatctgccttgctaatttgcaaattttggatattcacccctatgtaaaatctccgactcagtttttcagtaattgaataaagttaatcacttttattggccagtttactttactttttgagactaatacatagaaatatcaagatgttttaaattttgttttctcctgttttttcttctatgtatcaacttagtaaatgtcttaatgttcatctctaatctgggggtttacattaaaggatacaactaaaataaaataaccgccagttaattttaacctaaataatttttagtgttctgtgcctttagcttaaccaggactcctggcttggatgcagtggttacatgtaggttctggagttggtctcactcactttatgataattttggccaaggcatttaatttgtgtgtgcctacctactttttctcatctttaaaatggggatagtaagagtgcctacttcatagcattgttgtaaggattaaggattaaatgagacactggaggaacagggcctgtcacataacacatagtcactgaataaacaaaagttaacaaatattgatcatatgtagggacatgtgtctagctaataatgttactctctggccaaccctaaacttagaaaaatccccaaagcttcccttagcctgtttaccctactttggatcttaacttaaagggggcatatcaaatactaggacagtgattctcaacctcagtgacacatgtaaacagcttgggaactttaaaaattctgatgcccaggccatacccctatgaaatcaaattagaatttctcagagggggcacaagcatcatgtttttttttttgttttgttttgttttttttttgaataaacccagatgattcccttgcacagctaaggctgagagccactgccctaggatatttgttggaagtgttgtcattagggttttaaccaaatcactgaaaagttttttaatcaagtccttcagaagagttgcgggataggtccatgctcctcaaacctgaatgtgtaaacccatacctggaggttgcgttgtggtttcatattcactggggctgtggtagggcctgagattctgcttttctagcaagctccaagtgatgcacatggtgcttctgctgcatccaccgactttaggtagaaggggattaggtaaccttactaaagtgctctgagcaagttggaagaaacactgcttttgtcattattgtttaccttgggagaatggattccaggatctgatgttttaaagagactgtaagtatgtttttagccaagcctgtaaatattgaccttctaaggtatctttaattatgaccgactcttggtttgtccttgcagggctcagaagcagctagtaaaggagactttctcttcagcagtgatcacctgattgaaatggccaccaagctctatcgcacaactctcagccaaaccaaacagaagctcaatattgagatttccgatgagtacgttcatgtattgtttgaaaaccctttttctctttcagcttttttgttttagttcagctctcgatctcattcattaatacaactacttattaagtaccaggtatgtgtctagtagttgttccacatgataaatgggcagtgaatgacactgaccaagtctccaacctcatgtacctgacatcctagtggaagagaccagtatgtacaaataaaatgatgaaatagttgataagattttggctaacaagtgtttatggaggaaaaaaagggttaagagtcagagagtaggccaggcgcagtggctcacgcctgtaatcccagcactttgggaggccgaggcaggcgaatcacgaggtcaggagttcgagaccagcctggccaacatggtgaaaccgtctctacttaaaatacaaaaaaaattagctgggcgtggtggcgggcgcatgtaatcccagctactcaagaggctgaggcaggagaatctcttgaacccgggaggcggagattgcaatgagccgagatcgtgccaccgcaatccagcctgggtgacagtgtgagactccgtctcagaaaaaaaaaaagagtcagggaggcctctttgatgtggtgacatctgagactggtataaatttgaaatttgcttcttcaatttctcattagggttctgaatatagaagttagttatttgcatacaggttggggcatccccagatttattgtatctatctatgtaagtgttttggagaaatctgagttactgtgttgattatacttaattggttacctttcaatagattgtttacctgcttatatacttctttgcatgtctagattgctcaggaaattatattcttttctaattaagaattttctagtctattctgtttcaactcttcctaaaagtctttctaaaataaatttacacccatttctgcccctttgtaagtcagactctctttgatatgttaggattttgcagtgctgtgggcttttcttaagttctcattgaagtgtttagatttgggtgggaggttgggcttcatgtatactctatattggaaattgctgttcggactaaataacttttcttgttaatgagatctttctcataaagaaattaggaaaaaaataatggttggtgtgtttcagttaaggatttaacacgttagggcctattagagctttaaaatccctttataatagttgaagtttttcataatctgggagaatgggctttggtggggctgctaattctcactcaccatgggaagatcgtatgtatcccagacagcagaagctcctcagtgtacagacgaagcagtctcatagttgtcccactatgtgaataaactcatctttacacagaaaggaaatcacaccaacatccagaccacaaagtactgctatttttaagcatttcccaaaccgggattctaggaacattgcttgtacaggatgctaataacgatgtactgtgaaaaaattgttctctgatggaaatttaaaatctttcttcactacattacatctcagagtccctgaaatcttgttgtgattctcctgaggagctttgcggggatagcgtgtggcgtgaatcctaaacatagtcaaccacagagctccttcagcagctctcacagcttgtgttcgaaggtgtgccatctgggaaagggggacagttcgcttctgggcagcaagggccctgccctgtcacagagggcgtgtgatgttctggatgccataagctttcagtaaacagttgtctgagcgaagatttataatgtggccacatgaagaaaacaaacattgggtagcattataatgcctttcattctccagtgcctaattattgattggtctcataaaaataaaacagttcataggactctacatagcacccgtgggtcccttccccaggtggcacaggaagcctgcagaggaagtttgtaggtaaggatcgtaaatctccttagggagcattttgaatttaaacgaaaatgtccaaagtcataggcaggggcgcctgttcctttatgtgtcagccctaagtggcttcgctagctctatagaaccagtgttgaaaaccacatgcagtttagtgactaagcccttccttgctttttccttcccagaagtagaagtagttactctaacaaacctagattctgtaatcattatggataagtggatgtcagtttatggaaagagagtcaaagtcctgtttactctttagtggattttttttttttttttttttttttgaggcagagtttcgctcttgttgccaaggctggagtgcagtggcacgatcttggctcaccgcaacctccgcctcccgggttcaagggattattctgcctcagcctcttgagtagctgggattacaggcatgcaccaccacgcctggctaattttgtatttttagtagagatggggtttctccatgttggtcaggctggtctcgaactcctgacctcaggtgatccgcccccctgggcctctgaaagtgctgggattacaggcgtgagccaccgcgcccagcctgttcagtggaatttaaacttgtacatatagaagtgagaattgaattcattcagagattcagctgccttatagtttctagtccttaaacttctaagctgttcaatgtgtaactagattgcattttaaggataacctgcaagatgtgtaatgcagttatgcaccacataatgacattttggtcagcaatggattgcacagatgacggtggtcccctaagattgtaatggagctgaaaaattcttctgtctattgatgtcacaggtgttgtaatgttatagtgcaaggcactactcacatgtttgtgctgctgctggtgtaaacaaacctacttcactgccagttgtctacaagtaaaagcacatacaattatgtacaatatgtaactcttgataataaatgatgttgttactggtttatgtatttattatactatacttttttttttttgagactcagtcttgcactgttgcccaggctggagtgcagtggcgtgatctcggctcactgcaagctccgcctcctgggttcatgccattctcctgcctcagcctcccgagtagctgggactacagctgcccgccaccacgcccggctaattttttgtacttttagtagaggtggggtttcatcgtgttagccaggatggtctcgatctcctgaccttgtgatctgcccgcctcagcctcccaaagtgctgggattataggcgtgagccaccacgcccggcctatactgtactttttatctttattttagcgtgtatgcctacatgttaaaaaagttaatagtaaaacagcctcgggcaggtccttaagggggtatttcagaaggcattgttatcttaggagaagacagccccatgtgtattattacccctgaagactttccagtgggacaagacatggagatagaagacagtgaaattgatgctcctgaccctgtgtaggcctaggctaatatgtttgtatcttagtttttaacaaaaagtttaaaaagtaaaaataaaaaaaattaaaattttaaaaatagagaaaagcttatagaataaggttataaagaaaatatttttgtacagctatacaaagtattgtgttttaagctaagtgttattacaaaagagccaaaaaacagccgggcccagtggctcacgcctgtaatcttggcactttgggaggccaaggctggtggattgcttgagcttaggagttcaataccagcctgggcgacatgacgaaaccccttctcaacaaaaaaattaaaaaattagccagccatggtgacacacacctgtagtcccagcttctcaggaggctgaggtgggagaatcatctgagcccgggaaggtcaaggctgccctgagccatgattgctccagtgaactccagcctgggagacagaccaagaccctgcctcaaaaacaaaacaaaagtgtcaaaaatgtttttaaaattgtaaagtttataaagcaaaaagttacagtaagcaaaggttaatttattattgaagaaagaaaaaattacctataaagtataccgtaatgtaatgtcctaggccttcacattcactaacaactcactcactgactcacccagagctacttccaggcctgcaagccccattcatggtaagggcgctagacaagtacactattttttatcttttatgctattcttactgtaccttttctattcttactaagtttacacatacaaataccattgtgttacagttacctacagtacaataacacgctgtagcatctaggtttgggtaaatgcactcactctatgatgtttgcacaatgacaaaatcacctagtgatgcatttctcagaatgtatcccttttattagatgatgcatgactatatttctaaaatcaagttcccaaatagagtaaaaactaaagtgaatttgtttcattaaacattttaaatatatgtgtgtgtatatacatataggtatacacgtgtgtacaatagatacacatatatcatttaagttatacaattggttttctgaatatttgaaatccaaacaactaatccatgttccttttaccttgaaattctaactggtatgaatgccatgaaataatacattccatgttattgtttgttggaggaggattttctcttttctatgaggtgaagataaataatagtgcttacctcctaggattgtcttaaagcctgatctaataacatagtaaatggccaagcacagtgtggtatgtagcaaatcctcaatatatcttgcctattgttatttctagtgtgaatctttttttttttttttttgagacagagtcttgctctgtcgcctaggctcgagtgcagtggcgagatctcggctcactgcaacctctgcctcctgggttcaagggattctcctgcctcagttccccgagtagctgaggttacaggcatgcaccaccacgccctgctaatttttgtatttttagtaaagacgaggtttcaccgtcttggccaggctggttccaaactcctgacctcaggtgatccgaccacctcagcttcccaaagtgctgggattactgtcatgatccaccgtgcctggcctctagtgtgaatattaatcaggaattatagacatggaaacagttaatgtaggccaaggttattggggaaagaagttcctatacatttattacacttacaagtggtcttttttatttattttgaggcagagtctccctctgtcacccaggtcagagtccggtggtgtgatcccggctcaatgcagcctcctctgcctcctagctgcaaacgattcccctgcctcagcttcccgagtagctggaattacaggcatgcaccaccgtccctggctaatttgtgtatttttagtagagacgtgggtttgccatgttggccaggctggtctcgaactcctggcctcaagttacctgcctgccttggcctcccaaagtgctgggattacaggcatgagccactgtgcccagccacaagtggtctttgaaaataaaaatgtgaaagtgtttgatttttaaaatgtgtgaattttcaataaacctgaaagattttttttgagacacatacatacaagtatatatgccagagatatatctcaggtagttgaatctggaactatagctgtcctttcctcattgctttcaagttgaaaatgaagaacccatttaaaagatcagaagcactatccttataaaacaactgatgaattagaaacacatttgccttgtttcattctagcagataatgtttgcaaaatgtggcctctttagaccttgaaactgaaactaatggatacagagcagagctgtggatcctcacatcgctgggggatgtcagtaagtggtcagtggttgttaggttgactcactttagtaatgtgccattgactgagaaaaccatccctgagaatatggaaaatgtcataatgctatgctaattatgagggtagagagaagagatcactggttttggaactggaagacctggtttctggcccagcgatgcagctctcatgtcccccagtgatgctatcctcagttcagggatctcatcatatacagttgggggttcctcgcagcaccagcacagggatggtgtgaagaaccctctgtggatgctcaattgtacacctaaagtcatctcttatcccagcagtggtccacatgatacactgagggaaaaatacactaatggattttttaatccatgaattaatttctatacactaatggattttttaaatttttataatttttatataaatattttaatgggtattaaagatatatgtggtagatcaaacacatgattttatgcatattctgtaggtcactattattttgaaatacatttaagctagcaatagctattagcatactatgcagataacgacaaaaactatgtaggacatatgtgagtaaccagtgtttagaagccatagactagagggttgccaggccccttccttttgtgaaattctttacctcattttctcaatttgttgataatttaataggagccccctcccatattttttttttgccgtggaaaaatggaaatataacctgttggtctttccatttgaaacacagaaataattcttagcctttctaccttactagaatatgatgagttaatgaactttagttttcttagggctaaatgaggactactggaggtaaattgcattgatacaattctgtgtaagaagtgctcatgggaagaagtgatacaggttgagtctcccttattcgaaatgcttgggacaagaagtgttcccagtttcttgttttggaatacagtcatgtgtcatttaacttggggatgtgtactaagaagtgtgtcactaggtgattttgtgcaaacatcatagagtgtgtacttacacaaacgtagatggtatagcctactacacacataggctgtatattatagtatagccaactgtttatagcatgttactgtactgcatactgtaggcaattgtaacacaatggtaaatagttgtctatctaaacagaaaaagtacagtaaaaatacagtataaaagacaaaaaaatggtacgactgtataggccagctccatcataatcttataggacccccatcgtatatgactgacagtgaattaggtatgtttacatcagtcaccacaaacatgagtagtgtattgccctacattaggagagctatgacgtcactaagccataggaatttttccgcgcttatgggaccaccatcatatatgtggttcattgttcactgaaacgttgttaggtagcccatagactgtacttgcattatacttaatgtttcagtcttaatctgaaatgttccagcaagcatttcctttaagcatcatgtcagtgctttaaacatttcagagtttggaggtttcagattttcggattaggttagggatgcgcagcctgtactcgtcaagatcagtatccattaaaatacaaaagcaagtgttattgtaatcatgagctgttttgtgtatactttaatttgttttattcttttctcctaggttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtc

SEQ ID NO: 147 - DNA, 180009 bp, Homo sapiens; identical to SEQ ID NO: 146

SEQ ID NO: 148 - DNA, 179862 bp, Homo sapiens
gccccgcagccccgggctgggcccgcgtcccggagcgccaccggagagcgaggacgacgtggaggcggagtggcgcccggcgaggtagcgccaggcgaggtagcgcgagcgctttctctctctctcccctgcccttccctctgcgtccgtcgtcggcccccgaggcgcctgctccgcgcctttgtgcccgcggtccctggccccgtcgcaccctgcgggcgggggtcagcgggctctgccgctctcttgggagacgcggcgctgcggcgggaacggcgcacgctgtaggttgcggagggtggtcgtgactccgcagtggcttcgggggtggcgggagggaagaagggcttgtaaactaagttgctcttactttgccccatgcctctcgtacctgtgggcagagtcgaatctcggctgtcctcgtgttcacccacagcccctccattcctctggcccacagctgtttcctggccccctggaaagacacggtgtggcttcctccgggcaggaaagcggagggagaacaatggggcgtcctggggagtggggttcaggtgcggtgtgccccggcggcggcgggggaggaggggcccgggacgctgtgggcctccctgcgcgtgcagctgcgctcgcctcctttgttccgccgcagcggagggggttgccctgggtctcgtttcctgcccgggatgggattgattcacggtcccagagagggaaggggaagggggcggggctggaatggaaaccagattagagacgggagctacgaagggtggtggggccgggaagagagttggggagagggttgggagagggtgatgagagcgcgctggagaggtaactacaaacacacaacattttgttcaagggccatgtgagtttctagagcttatttgtagtgctttgttcaggcttcggcccagcgtttattgctgcaacaagttgtgtgcttcttgagtttctaggcgttcccaatgttagattgctcaaagcaaatcttcttagttacagtgaaagaagcccccccccctttttttttgagatttgaaaaaattttgctatgaactatggtattggtgtgtatgtgtgtgcctctgggtctgtgtgtgtagctagtggatattggctggaatgggtaggagacaaattttatagaatcaattttgacgtaaaattgttttatagtataatatagtacaacagttttccaggactgtttgagggcagaaaccaccagaaaattagacattgctataaataaatgaatcagactatgtaacacaattgaaaaacccttttacagtctgtcccaggaaacacaccacacacaccagcgtttggggtttgaactgaggagccctggcattgaagtgttctgtgctttcactctctgtgtgaggatcgtttagaggtggtagaattaaatgtaatgtgtcagacatttgttaagtgacctttcctagattggaatcgagactcgccaaaggattggctgacctagggagggagctatgggggattgaatgatgtgtgttttttgaatggggtattccaagcaaaactgttttgggaggaggctgacatttccaggcattcatggtttgtgcctgtgggacactggtgggaggattcccaaagtcggactgaaggttagcattactgtggtgataatttaggagacattctgttgtagtagtctggctgcagacagggctgggaagtggcccagagctgcctctttgacaagctgagggtccgccattaaaccacccctttggccatttattttgagatgaaccaagtttgaaagcctcttaaccttagaaggctaattaggagcttgctgtgggggaaaaaaatatctcctgcccactaagtggtaatggaaaagagctgtataagctactgctgagggtttgtctttttcgtgggggatgtggtcaaattttcaggccaggctgaaaagcactgggagttgtcctcaggagccattatgatgtgaagttgaaatgggatggtgtccaactgtcaagctgtttgtcattagaactaacacactgcctggcaaaacgttgtgctagggcagctaacagagggagactttttgttgttgttgtcttaccattttggacttttcacttatgctgtgaattgttttataaaatacaacacgattgaattcctctcaagtactcattgttctatacattaacaaaatgtaaagcatctgaacattgctgctactggagatgtggacagatagcagaatcctaagtggctggtctctggtctctggcctctggccgttctggtggatgcctgattgtgtgataaggctggcaacaggctgtatccccttcccaggatgaatcatcactttgtcaagcctggagttaaagactaacttaccctgattgctgcacagttatgcaaagcaaggaggaacgtctgacatcatggggaagaagagggagtgaggtgagtgggtggtgtttggctaagaagggatcttcagcatgtagcatccatgtttttagcatttgtcctcctttgggtaagattgtcttctacctcccttctactgttttcaatagctgaacatttggattttaattaaatagcctaacaataattatagctatcatttagtatgtgttcattacatgccaagaattttacatacattactatattcatcatcacaacaacttgataaagtgggtgttatcttcattttccagtggaaactgaggcctggaggagttaagtaacttgccccttacaccgtacagatgctcctagatttacaatggggttatgtcctgataaacccatcataagttgaaaatattgtaagttgaaaatgcatttaatacacttaatctaccgaaccttaaatgtgtccagaacagtcacattagcctacagttgggcaaaatcgtctggtaacacagtccactgtagagtattggttgttcatccttgtgatggtgtagctgactgggagctgcggctcgctgccactgcccagcattgtgatggggtatcgtactacatgtggctagccccagaaaacatcacaattcaaaattctaagtatgatttccactgaatgcctatcatttttgcaccattatagagtaaaaaaatcctaagttgaaccattgtaaattgaggaccctctgtgcttgtgtagctaactactaagtggtggaagtgcgattggggatcccaaagtccatactctttaggtatatactgtatggtatgatgtattttaataataacaacagtttgattatctagttggttagcccctggcagatgtcaaattactttcacgtctattattgtagttgattcttccaaaaaccactgtgagataggtttggaagcccaggttaggacattacaactcttagaactgtattgctaaagagctgtatgttatggcctgtatgaataagctgtaagtgaatgaaactttacttttaaaaagttaggttgccaacatttaaaaataagttcttttttcgaaacatttaaaagtggtagaacagagtagatcttatattgcactcaaggcttttatgtttattgaaatccattttaagccctttttatcttacagcctttaatagaacattgcactttgcttcttaactgagacccgatgccagagtgtctttttaagaagagaaataaggagggaaggaatgtgcttataaagaggaagtgggacatcagaattggaaacactcgcagcagcaggccatagatttttcccagcacatgctttttgtcctggcagtagccttttacagaaggcattcttccttagggaagtgtcaagggtctttctttacagtatcctctgagatcatcaaatttctgagctctgtgggaacactcattccacatgatttttgtgctcatcccttccccacaggggaagtgaactagtttaggcatctgcatgaaaagggaatagcagtggtatctgtccttagggtggcactgagagtggcactgggcaagaggtaccagactttgacaccaagtacaggagcagactggagtttaacacttggcatcatggattgtttgtggattcctcagaatgctcctgggcaaatggaaaagtcaatattaggtttttgttgttgttgttgtttctaagataagaatttgaagactggaagttctgccttgtttatttatttcaagctaggacaccatttggggtcttcaagttctgtggtataggtgagagtaactttagtctcctcaggctatgaaattctcctccactggctattttagacttttgcctctggaggagaggcagacacatggtttgctaaactctaacaggtgagcaccttccaacttaccataagcagcatagaggaggaaaaaggatgcttcccagcattacactcttacagcctttggtaggtctttgcagttgtcagcctcttcctcatcagttcatattttattaagcacacaggtcatgcaagacaatgcattagacccattttaaaaggaagaaaggaaatccattgtgctttcagggtcgttgtagcagggcaggtggatgcatcccaagagtggatgttggtgaaatgaagaaaatggctatgacagctgtagtgaccaagaccaggggaacacttgcttttgagacaaaagctgagaacaaacagaagcaagagagtggaagaaaactgaacacaggtgccagcttctctgacttaggttttatttcctccaatctccaatgatgtgaaagcgttcaggttcagaaccctgactgaggtccaaaaaatgatatataaactaccattctatgcgagaaggtttgaatagcagtgtcttccctggtgcatggcaggtccttggtacctccgccaactctcttctctacacacctgccagcatcccttcctcatcctgtgttcaatgtggctgtcaactaaggctgttaatagacttcaggcatatttgcattttaaaaggctcttgtggacaagacatgccaaatctccaaagaatgagtcattcacattgagttatatgatattattcatgctactgtttattaagtattgggtgcttgctttgtgctaggcctcatgctgggtactttctgtaggttgatttccttctcatcactatcccttagtaggaggtatttgtagatgagggaattgagtcactagcccagaggtcaagcctcaaagacccctttgctttccagaacaacgaagtgccaccaggtagagtgtactgtgaagctttgaatgagtactgtggagctttgggcaaaaactttgattctttgggtgagtactttgatgctttggtcacttttaaggagttctttttaaggagttagagggagagcccagctgttgtccctctccttcctggcttgtttcctttgtcacctgaagtcaggattcctgtaggtgtccttggctggtccaaagctaggagaattggttgaactgcttctcagtttatccttttctgggtgttttggcttcccagtcctgcgtcattctccttccccagctgagggagacaagattcagcctgctagtgagagactgaatagccagtcccttttcttacccccttgctggccatgcctttatcttcaggaatagattgtcatctgggagtttcagggcgtttgtctgatctctggtctccagtctgcctgcgagcagcatgccacagggcatccagtcctggagctcgctcagatctttgatgtgtgagaataagcggtgtggatgccattgcagagctgggttttgggaagagagttggggtgaaatttgtactcttccaagataggcagttttataaatagcagaaaagtaaaaattgacattcttcttttgcttatcagataagcacctgataagtttctgaaaatgcaaggggcctgtctttccttgatagcttaagagaggcttaagaggaaaccaaatctctgccttccggggactttcagtccaattcttcctggactcaagatgctttaagattgcacagatggcttaagttcgctgtgttaaaatgaaaatatagtaatgtatttcagaattgtacattacaggtttttaaatttgtttaaaaaaagaatgcaatatctttaaagactttttagaaaattgaattgaaaggacagtggaacagattattagttatcgacattataatacatttacacgtcatttgcctacttaattttcactggttacatgaaagcattttcacattgcaaccacaacaaaaagctcccccaaaatacacaaagaatcttaattgcaagattcctgctggtcccacttaacattttccagtgtacaccttctctctccatcattgctgctttgctttacattttatattagatcctgaattgctatttgtgatgttcagattgcaaatatactagcttcctaactgatcattttttcccttaaaagtacttcagagtgattggtcactgttttattcattttagacccacagtctaaatgctttaaggaaaagcttaattttcatagacattgggcctatgccaatttgcatggcttgttatttttgtgatcctcatattatctgcttctagtcataatcggtagatcacagttttgagctacccctgatatagtgagccatctatgaaaaagttctcgcttgcctgaaattttcaaagtgttgagagctattcataaaaatgtatgaactgccacgttggtcaggttcagggcttatttgccgtagtactctgcaggtattctgtgacattcaggaaggaaaatagagttagactcctgatgtcagctttgtaaaggttcatagatgtctcttgagtatctgtaattacatgatctcttaaaaacctcttatccatgtactgaaattcatcttgaattgtttatttttatcctgcattcacacaattcacactttaaagatagaacttgattatattggtatttttatttcaaattttcaatttttggaatggcagaatgttgctattgaaaagtgtcttaaaggtcaccactgtaaccccttcattgtgcttgagacctgctcagctcctaaatttaacaggggacggatctgagaaactgactccaagttgtaacctcttgcttagttttctttctagggagatatccgtctctccaaacctgtcgaaatctaaatttattacctcttacctaatacttggtcccctgtggacttcacttcactgtttgtgctaatagccttttcatcaccatcttgactttggattctagagcatcacctacttccccattttctgtgacccttacattcctcctgtcagtcactatgtctgatttattgttctcccctatcttttgccctttgcaaatcctcaagccctcattctggttcagacctttaaaaggctgagttactggagtatagtgttacccaaagtgagttgttccataaaaaattagtaagttggaaaaaaaaacaaaaaacaaaaaaataccctacccataaagttggtaaatgttcctgtaaaaagggttccttggccaggtacatgttagaatagctggttaagtttctttgcagaaagacttctcctggccttcatttgtgactgtgtactgtgaattcccaagagaaagatacagtattcacttgtcccaacttatgtcaccattgtaccacgttttggggggatcatttcgtagataacactgctatagtcacttcactgtagctttttaggttctgtcactgcctggcttcctgtgggaatgtgcattccatgtgagccgtacttggttcactctcaactgtgtcttgtgcttttaccttgttgttctggatcgttccttccccccagaagcccctctcccctatcacactggcacatctttcagtgcccagctttgtgcctgtcttctctgtcagttttcccagactcaggttgcgcttgttcttctgaacttaactgtttcacaacttaaaaaaaaaaaagaaaatatttgaagcacaatgaaatgttgaaagtaaccttacacattcatatggttaaattattggaattcccacaaaattccattttccatatttgcgtcagttgacacatcacatgcacatcacattctcctctgtttccccccacaggttagcttgcacatatgttcaacaagcttgttgcttgtggggcttttttctttaattttgtgttactgaaattgtgttgcatttaaatagaaattcagggagaattgacatctttatggtttaatggcttcccatccacaaacctcataagcttctttaatagttcttttatgtccttcaatgaaatttttatcattttgtatgtaaaactctttcataccgcttgttagatttgtgccaaggtgcttcatggtttctgtggtcattttgaatgaatgatttagtacatttctggttagtgttgctggtgtacaagaaagggattgattttgtatttgtttataaatagttcttgattgatcaagttcacatctaaacctgtgtttgctgtgggagcctgcagttgggtggcttttccaatacagcataaaataacttagcctttattgaaaatgtcataattcactttatttttatttatttatttattttttgagacagagtttcgctcttgctgcccaggctggagtgcagtggcataatcttggctcactgcaacctccacctcccaggttcaagcaattctcctgcctcagcctcccgagtagctgggattacaggcatgcaaccaccacgcctggctaattttgtatttttggcagagatggggtttctccatgttgagactgatctcgaactcctgacctcaggtgatccacccaccttggcctcccaaagtgctaggattacaggcgtgagccaccgcgcccggcctcttttttttttttagagacaagtctggctctgttgcataggctggaatgcaatggcatgatcgtagctcggtgcagcctcatactcctggactcaaatgagcctcccacctcagcttcccaagtaactaggactattggtgtgcgcctccatgcccaactaatttttaaattttttgtagaggtgatgtctcattggtcccaggctcctggcctcaatcagttctcctgccttggtttcccaagtgctgggattacaggtgtaagtcaccacacctgacctaatttaaaaattatatgcagtacttttagaagtaaggaaggggtgacttttagttatttaatgtgttcatttattaactcatcaaatgtttaggtgcctagtatgtttcaggcaccgtactaggtactgtgtttttgtttttgtttttgttttagagacagggtctctctttgttgctcaggccggagtacagtggtgtgaacatagctcactgcaggatcgaactcctgggcacaagtgatcctcctgtctccacctcccaagcagctaggactacaggcagcatctccacaccccactcattttttacatttttttgtggagacggggtctttctatgttgcccaggctggtcttgaactcctggcctcaagtgatcctccctcctcagcctcttgaagtgttaggattacaggtatgaggcactacacccatcctgtactgaatctttaatgttgaacaaaacagatgtggtttctgctctcatgaatgtgaaggggaagagacattgtggaaatggacacggataaatatgtattcgtggattagcatcgatactgtgaaggaaaaggacagggggctgtgagaaacagaaaggcggagagagggaaatttagattggggtacaaggagagcctgacttaggaaataaacattcacacagctgcctgaaggatgagttggtgttaaagaatgaggaggatggaagaactttgtaggcaataaaaagaggctcagaagccccaaggtgggactctactctgaatgacacaaagatgggaattttagtgactgatgacttaaatcaagttattaattcttagtaaattatcataatagtggtatttaacagtgttttacacactattatgacaaagtgaaggtatttattttttatcagtatatcctcatcctgccaagtgaagctggctagattcagagagctgcctctatggtgaggcttgaatggggccactgcccacacccctaccccctctgcattttgagtattgccactgctgctgccattgggtcctggcatctgctggacacgagcgtcctgctcagcaattttctcctgagctctgcactaatagacggggtcctttaaggtcaggtcaggtcaggtcggaagaagactgctctgcccttcctgggaggggtggtgagcagggccttctatgttttttccagtgtctcagccttctccactctccctccttcactgtctcttaaacacacactgagggctcaggcatgacaatgggatgggatccaaactgagttacacacctgcctagaatctgtgctctgtttggtcattgaagcattgctctggggcaggcatgactgagcttagttgagataagtcctctgtatagtgaaaagctatgtggtgcagtggttatgggctgggctctggagacaatactggtttttgaaacttgactcttctccttagtagcccccggaccctgggcttgtagcttaaacggtctgcctccattttctcatctgcgcaatgtgggtaattttgcagagctgccttctttgggttatagtaaggattaaatgaatcaacacatgtgcagctcctagaacagtgtcaggcacagagcaagcacttggtgtagatgttagttactactattcagcctttcctgcaatgctttcctggggttcctcctcccccacaccagatatttaaatctgtttgaatcctagcagtgcacataatttaggatttcatacgagggacccctttggaaaatatggggagaaagatggcaaaaaaagaaaccaaaatgttaagtgattgtgttacgataatagattggggtgacttttacttttaactctctattttctaaatcttctataacctggttatgttacctctgtactaataatataataaaattatttgaagaaagaaaagtcaggctggcggtctccagttggtttgctaaaaagggacaggagagagtgagaagccaggggtaggcctgctctagtggcattcacaggtgaagtaccttcccatttgtgcttatagttgcagaaactaggtaacggtgttgaatagtctttagcagaagtatccccaaaagttagaagatggggctattccttgtgaatcccccttttctgtgaattttttttttaatctgtcattattttccctttttgtttgttctgtgctcccttagtggtcctcttgccatatgtctctcattcagtcccctcttcctcccccttccccttgaaagtctctccttttaatccatcttctttacctactgtcatgcagaaattatgcacccatttattcaattcaaaataaagcatcagttttatttttattgtcaaaataagtaaatataacttttcactctcagaaatctaaatgaagttgccctttacttacttacacctaaattaattgattagttaatttatttgctgacaaattaatgaactctgggggtctgtgacctcctaaaagcaccaggaatcttggaagattgggtggctgcaaggaagggaagattgaggggatgttgaagttaaatttttcctctttgcctattttgcatagggttatctgtgttgctgccattttggtatatgtcagaatttttgaacttttccaacagaattctggaaaattaccaaaatacatttttacaaagaaaccatgccaaatctgacaaatttcttcaaaagcccattgattttaatcactgaaaagttcagcgaactttccagcttttctttcatgctgctctttttatgtaattgtgggtggagaaatggactttcctgcaaagtgtgtttatctacaggaatttattcttggcagtggcattttataagtatcttaaaaataatgctgacatagatttgaaagaaggtagtgggttacagtaatgttacctgctatcagctgaagagctgtttacatgaggaatattgctaatttaatgatgctacacaattgagtgtaaaatctagtggaggacatttaaataaacggaagtaaggtgatgcctttctgtaccttattccacaatttaggtattttatcttcaatgacaaatgcctaatttgaacatatcataaatatttatgatagttctttttctgctttaaggaagtctgggacaattacagtaaaatctagttttataaaatgtgtatacctagacttagcattggttttttcaaaagaagacatcataggaattttttaaattagaaccaatatatgtatcgcttaatgatgggtatacattctgtgaagtgtgtcatcgggcaattttgtcattgcgcaaacaccacaaagtggacttaacacaaacttagatgggacagacaaccgtatacaggtacagccaacacaagtatagccaattgctcctagtctacaaacctgtacagacgtgttaccatactgaatattgtaggcaattataacacagtagtatttgtgtatctaaacaaagagaaggaatagtaaagatatggtataaaagataaaaaatgttacacctctctagggcacttatgaatagagcttgcaagaccagaagttgctctgggggagtcagtgagtgatgggtgaatgtgagggcctaggacgttactgtacactgctgtagactttataaacactgtacacttaggctaccctaaatttataaaaacacaaagtaattgcatcatgacgtcactagtcgataggaatttttcaactgcattttaaacttatgggacctccattatatgtgtggtctgttgttgacagaaacagatgtggtgtgtgactatatcccctttttgagtagggcagcggttatagctgcttatttgcttttgtcacagagctacatgatgttggcatgaccttgtatctccacttcatacacactaatactgtggaggaggatcaagtcgttgggtttagcctaggcatgccaagggtatggcatgagcatggaacacataatgctagaactgccagcccagtcttaatacttagcactggttgccagtttaaaaaacaatacaaaggtataggtaaaatgttaaaggaaacttgtactaatttatgtcctttgaagtgacctttttgtgtctcatggaccctgggctgtagtacctgactatcttctgcaactcggatggagaaaatgccccttccttacctggcaggcagtgagccaggctggacattagatacatagtcgacttcacctactctgtgatttagcttccagctttaccgtttgctgtcttggcagcagcttgtgcatggtgaacttttctgactagaacagttaataacccccacagatgttgggagcccagttttgcagctgttgatatgtccagttggatttcttgaaagaattaatcaattttgaagatctcatgccgtgggctgcaagcataataggatttagggggaaactttattttatgggagtttgagttggtattgcaacagatgtagcaggaggttgaacagcagctgaagggatgcaggaaaatggagtttaaaaagatgtttgtgggcctaccactctaaaagtgtcaactgtggtcatttctgaatattcttttccaggctttttatgtgaatgttttaaaatgtgatcataatcatagagtacatacattttctatattgctacatagtatttgaaataaattttatagttgtgtattattccattgagtaccatcattttctgcagcatccctttatttttgggcatttgtattccttctgccactttgctgttgtgaataatactgtgatgagcctttttgtacctataaccttttctatattttgaatgattttctgacagtagatattgagaacgaggtgattgggtcaaagattgctgtgaactctttgatgtaatcaggtaatggatggagtgacttggttggtggggcagaaagagttggagtctgggataactccctagtttctggcttgtgtgatgttgggaatggtttgcatagacagggccacaagtgaggggttcattttgggatgtggggcattcaggcagtgagggagcttcagggactgttgaaatgcaaggtccggagcttagggaaaagccagggcctggggttcagatgaggggatcatgggcagctacgtgtggtggaagctgtggataatgttaggattgcttagagggtagagtgagaagaggaaggcggaggatagaactctgggaacatcattctgtgacaagtagagaatggagaagcactaaggaaaataaggagtgtccggaggtgggatgtggacagccagggtttcctttcttttcaagagcttactttggttaaaataagattgagtgggtagctatccctgtagagcctgggggcagatttattttggagggtataatattacttttttcccagataggctttttttttttttgaattaaagctatatagaagttaaggttattctatttggtgctgagtggggagccttatatgcatggtactggggtcaggattgacttgtatgtatgtgttatttaaactgttttggttgttttgggcttctggtgtgtatatgtttacataacattggttgttttggggtttctggtgtatatgtctttacacagtgttttagtagtctattgaaatatatcaatatcatttttacacaaaagaacatattttttttgaagagagtgaatgtcagatttctaaaagtatgtcaatcatgaatggatttaccatttagctacttacaatagaagcacccagatttttctgggagcctttgcttttttcaagagagtgatattccttttcagagaaacatttgtctgtgttgacaattttaaagaagtatgtaattttaaattatgaaactcaaatttagtttttaatagtaatttctgtgtttattctttctatctttaagagccaagttatagaatgacatgtgaccttgtactcttgactctatgtctggttgtggatttgaagtgttatttttgtgctttcctaaatgacttaagcacttatgactatatatttggatcagaataaatatggtagttggatatacttttgaaaagccaaccagatttttaacctggtaataccatagtactattcattcttatgattgtccagactcacagctttagaaaacagtctaagcttttattgacttccagacttgctggatttgttggtgttctctttttctctgtaaagtggatcagccgatgccatagatacactaatgctccaagctagagggctaccctgtagtgtgctcttgagtttcttttcccaccagttgagaagaatgcttctccagacctgactgtgttaattcccagacctgcgtgtgcccggtgtacttattatagtttaatacaatgattttaaacatgtgtgccaaaagaattgttgtttctatgaaaattcatttgaattctttggaaatcacctgataagaatgaatttccataaatgactgcagctaatttaggagtggctgagataagtaaaaaatttgggggatcataaaataaaagtatcctcactgatattatcagtcattcatgattggtgggttaagttgtgattatgtaaaactcgataatcgtactggctcaaagcagtaacccatgttcacactgtgtgtccgttgtggatcagatggggactctgctccatttgtccttaaccttactccagaacacagtctgatggggcagtaccttctggaacgttgctggtccctgtggcagaggggacgcctgctgcaaaggtcttattggctatatgcctgaattcagcaaggcgggacgtagagaggggtatggggcatttgtaaagggtaatgaggtctaccgcacttcactttccagggctctttagaacctcactgttctttaaataaattggacttggaggatgatgccttgggatggtttatagaagaaagaccattgagtacaacagtggacatatactcaaagaaaaggctccagcactataacaaaagattgacaataaatgtatatttgtagagcttcatttaaaatgacttgtttaggtatgtatcattttttatgacttccaaatttaactgacttaaaaaaaaataagccaaattgtcaatccttatgcatttggataagagaacctctactttagtcttaaacgctcctgtctctcttccacctctgtcaaattagtttcccaccttttatgatagactcatctgtgatttcccttggcacatctccttttcatttccattagcattatcctaattcttgttcctcaactactagattggggccccagatgaattccttgatatactgtcttgtatagggcctgtatgcagtgagaaaaaggcactctttggggcagacacaatcccacaggagctcaactttattttagtcaccttattctgccgccccccctcctccccagctggcccacttttatgcagtacacaaactgaacaactgcacagagcagtcctcctccctgcatttagtcgctttgccaacaaattcagactgcccatcctctgcttaagcctcctttaaatttgttgtctctattgtgctcaaaatcattttggtggctccctgtcatctgtatgtagtggctgacctcagttttatcttccatgggaccatcaccagtgactctgagccttagttgttgccatcttgatgtgtgacataagtaatgactgtagcacagatgcgctggttaggctatgtaatgcttctctctccccgcccacccattcccaccactctaacacctgtgagctccttaggtctgactcctagtctagccttggcttacctttcatcccagcttcattgttcatcaggctcctataccggccgtcctctgctaccattctgccaggtcaccgtcttctgaatatgttttttattcttgctttaaacttcttttctgcttaatcacatccaactcacctttcatggtcgagtttcacctcttcagctatccttctgtgattctcctgctgtatgatagtagctgtacctctaaacagaaatgttcatctctatattcctccttttgaggtgaatcgcctgccctatatgaacatattatactggttatcttactcttaagtattctttcctcagttagattgcacatgcatgagaagcagtagatgtgtctctcattctttcttctttcattgcctgctaagtactgtttgtataccagtagcatgggtcagagtgggaggttgtcaacagaagagtccagcatgtatccatgatggactctcgatcaactttatatgattaactcatataaaacagccctgtatggaagctgaggctgcctcttcctagccacaggatattgacctactttccccttcttatctgcttgcaaaatatttgttgtacttagtgtgttctccctgtcacaacgaatgtttgtctctctctttcatatgaactgaaggctaaagtgctagttaaatcagtggaaaaagcaatggagaagaaaagttggtaagcagttttaatttctaaaccagaggggccttataattttgtcatttaaaaagaactctagtttttctacccacctattgagagacagacgtaagggtagaaatgtaaattttaagttttgatgatttataatataataatgtattttgaaagccccttttttgataaactacttgtagaaggaagttaacttttcttaatcgggtttctacaaggtagttcactattgtatgttttatttcttaccaaaacttttcttgggaaaatttgttttattgctccatacgtggtcaaggtaattaactttaaaaatggattttcctatagctttacaggttattaacatgtgctgtattcaaggagaaaaaactgtgtgtgggggtgttgtcagtatgtctccttatataaatatatgaagtaactgctgtatcctgtagaatatttggaaattagcagaactattcaaatttagttaacatttataaatgtgaattttataaacaaaaatttcagtaaacattttatttgtgacttaaaaatgattagttatggcatgtcttataggttgatttgtttgtagtgtcttttgttcttcataaatacttcagaatgtatttaaggatatgtaagaattatggtgcctttgattttaaaaggaatgcttccaacattagaaaaaccagaaattgacctagaaaatgtttccaaattctaatataattgttgattttaatcagtgtaggtgaaataacccactgcagcagtttagctattttctttaaaaattatttctcaatttacattatcagtgtcttttttggaacatcttagctatttttgtttgatcaattctcaactaataaacattcatgaaatcctaatgtaaatgtataaatatctctgcctttgtttacatagtttattggactttattttagtggattactgcttgaggaagcttctgaatttttattattctaaaaaacttttttaaaccttgagtatgaaggcattaccaaagcttcactgttgagtgatgcatattttttcccctcctttacatgtagattacttaatttgtaatctttagacttttttttttttgctttcctaactaggtgaatttttaaaagtagccagttccattttgtagctaaccatgtattgtaaacacacagaaaacatgctcaaatgtgccttgatggcctaacttacctggttattctgtgcatctttctgtgctgtgtatggttgcactcttaatatattttattttggttatgagatcagaataaagagagctgctttcctttgcctctgagtaatgtcactgagagagattcttgtggtctggcatttgctggctttttggtttttaacattctctataaccagatctaggatgcatgctcatcccagaatgagcaaactcagtctttccagagttgagccttgtttttttttgttgaatcaacagcgttggaagctgggacaagatcctaggagatgatgtgttatacgctttgtgaggaaactgaggcttgaaggtggcagtgtgcccagtgtctcactgtgagctagctgcagagctgggcctgcaacttggatcttgtggatgttttttccagaaccactgcagtagtcgttgtaacctatgatctgttgcagaatgccaaagctgttgttttctggagggataattttcttccttaacctacaaacaagaatagtgcactaaattcagtacatttctctccattgtcactaaaagagcctgaacgatgggaaggcccctgtttttttttttttttttttaaagaaggccattctgccatagtgtatcccaggctgttttatgtgagtgtctttgttcagaaccaatccggagtggcctccaaaactaatgggtagaggaaaccctatgtgagtgcctaccaggtgcaaatcactgtatttttaattataatgaaggtgtaccttgagtgattgcatgatccgatcaggcataaagagaacagaggaatgaatctacaagtggtgtaagactttgttgaggatcttagcacatggaatgagattgagaccctctgattaataagctgattcatttggaagggaagttggttttcctctggtggctatattcaattcagtaatcaccagtctttcttggcgtctgtgcacccaccaggaacaaatcagagtcgggtgtgccagttatatttgaacagttttacgttcacttaggggttccggggtctcaggtttgccaatctaaacacattgacttcttggaatttttaaaatctgcctcgaaggaacgcattgaaaagtccgtgcgttataattagcatgttcccctgtacagctgagtttgtgtttctggatgtaacagcggtttatagtttttggctgcctcgtccctcaggaatttgtagccttttttcagacgttagctcattaattctccagtcattgtgagctgtatagcatgacgaccggttcccctacagctgggctgcatgctgcccattctggaccttctagggttgtggcaggtggggggtccatgttgagggggtggagagggaggcagggcatgactttcagacccagccttggagtggggtgtgtgctctctgaagttgacctgccctttggcagccattcctgccatgactctgtagagcttcctccgggaaatgactgtagggacagtggtgttggctgcatttcctccttagggtgttaaacctcatgtaagatcaactgcaaatgaggtaactcactaggttagttacctggacacacctgctaggagacaggacagaagagtaggtaagctcttcagggtgagaagaagaaaggggcattggagagggagaaattcatctaatgagtttgctctctcagtcaggctacataacagccctgtggaatagatattgtcatccctgagtttttagattagaaatttgaattccagagatgaattcctttggattccagcctgggtctgtggctccacagcctgtgccgtaccacaatggggtggatcgaaaggatccttggtggtaaactattgctgcaagccttctgtaatatagaagcaaaaactctttgaaaaatggtgcagtgttgtgaagagcttggtgatttaggaattagactgaagggtatatgtaatagaataggtgtgaaagaccattttcagacccgtcagaaaagcttcatcctcgccctggctcttctagaaaccagctggctccaccgccttcttttttaaaggaaggttttgcctgggattctaaggtctctctccttgctctttaattataaacaaaggcacttagaaattttgcccttacgtcacaagtgagagttggtaactggtaatccaaaaccttccatgttgttatagcagccgctgttatttttgactcaatttcttctaattagtctagatggtatattttgtcattctcactttacacagttgggaaaaaacttttttccctctcgtcagtttgcaaattgtaaggttctagatgctgtctttcagtccttaatcactggcctgtgcctgggattgagggtggttgattaagggtatctccttgttgatgacttttattgatgtaaggccagcttttctatactcagacagaaacagaccttgatcttggtggtgcctgtccctctctgcctatgcagagacaaaacctagggtgttaacccttagataaccagaatgttgaattaatagcccctcccactcacagctttttaaggttggagtcaggtatggcaaatgggcttccatttgcttttatccatttgtttgttttcacttcctgtttaaatctattggatttcttcattgcctggtaatttcatgtcctttgtattagccagaatttgaacacaagtcaacaacatactatatggaaattgcccagtagttgtgcctatttcttccataatccaagattttaacaaaagccctcctactagcattccattagacattttcagcagaaagctttagagaaaatgaggtgaggggtttctcaatatatagttggctttcacagtgaatttaaggattggaaaatgagagaattataattggtgaggtaaatgccatgaatagacacaccttatataaatatctttaagcaagtgtgtaggtaggaatgaaaatcagccatcacctaagtctttccacaaatgcatgtcggggcactcactttctccaatgctttagggagccctgcagggcaccccgtgtggttctgtgtggcccaccagccccatcacctttgagaataatgctgcttgagtaaattgtcctatagaatccagttttcacccagtttgcgtttttggttggtaaatactaaggaagtgtcttgtcctttggtttctaactttaatccttcatgaggacattcctggtgtgtcatcgaggctctctgatggtcctttgccagttatgacctggagtggaagggtagcgatgatggaaaccgtcctggacagaagaatgggctgtgcctgtctaatatgcatttatttattcattttctttctacacaccagagccctgtgtgtcagccacgctgttaggcatggggcttgtgcacattgagaacttaaacctcccttctccaggggaagagcagacaaacaaactcacaattgtgagggaagggaagtattttggcatattggtctgattgagctgctgtaacaagataccatggaccgggtggcttaaagaacagacatttatttctcacagttctggaggctgcggagtgggagatcaagttgttggtagattcagtttctggtgagggtcctcttcctggcttgcagatggctgcctttttgatgtgtcttcacactacagagaaagagcgaaccctggtttctttttttcttataaggacaccaatctcttcatgggggcctcaccctcctgactgcatctaaaccaaattactttccaaaggacccacctccaaatatcatcatactgggggctagggcttcaacataatagattttgggaggacgcaagcattcagtccgtaagatttggcttgctcacagcatgtctcctatgaggaatggttattgacactggtttaagttggggggtatttatgtctgacaagaggctcagtggaacctctcgagggcctacagctagaaccactctgggcagcaaaggcagctgttctgtctgcctgccatggtctgtcaccatgcttcattcttctcttcagataggcttcctctggaggagtctgggaaggttcacccgcatgatagctgttccctggatctctatgagctccatgctctgctgcccacagccacctgactgtggtgtctgtgtcctgctggcagatctttggaagctttgtttgggctggtgtatacccaccactcagttagctgtggtctggctgaaggtgctgtggcaggccttggcatctttgtgtgtgtgtaagtggggactgtgcaggggagagattggactaaggagaaaggctgtggaatcatgtgttctctgctaaggaatttcttttttaacttggtaaaatatacataacataaaatctaccattttaaccttttttaagtgtacagtttagtcacattaagtgcactcccactgctgtgccgccatcaccactatctctagagatttttcattatcccaaactaaaactgtagccgttaaatagcacctcctcattactctctcctcccagcccctggtaaccaccattctttttgtctctatgaatttgacttttctgtgtaccttatataagtgggatcgtatatttctactcttgggactggcttatttcacataacttagtgccctcaaggttcgttgatgtagcatgtatcaggatttccttcctttttaaggctgagtaatgttccattttgtgtatgtaccatattttgtttatccattcatccattgatggacacttgggttacttataccctttggctgttgtgaatgatgctgctatgaacatgggtgtaccaacatctgtttgagtgccttctttcacttcttttaggtatatacccagaggtggaatttctcggttacgtagggagtctgtgtttaatttgttggaggctctgctaaagaatcataatgctggctgaaaggcactggagagttattgaagggtttgaagcaggttatgcctaatcagattgtgatttgaaaaagtaacttgggtggtgtgggctggggaaaaggaaagggctggcaaggctgtggtggcgagacaaggcagagagaccccttagaaagctcttgaggggaagggatagaagtgagcttaatcaaggtgatacagtcagtgagacagattggatatgtgggaaggaaggaagagacagggagaagccaaggatgagaacctggatggatcaattgttattttgtggaatttagagggagtaagatttttcttgttttgttttttatattttggtgtgggatgattgatacaaattttggaaatgtgttgagctgttagacacagccaagtggtagagatgattggtaggcaggctgtcgataatatgggttgctaatttggggtaaaggagaaggtaagaataaaggagcagatggccatgcaatttggctgaatttaaaagtggtgggggcattatggatgcagcgccacaatttcagctcctgaggaatgatgtcacattcctaccttgagacaacatatcaaaatttacaaaacaaggaaaggtggccaattcattggttgtaaaaaggagctttcaaaaggattctaataagttcaaaaggatttagaccgaagcataaggatgttgaatttggcttatagtctttttgctcatctatattttctagtttttttctatagtgaacatgtattacttttaattattaaaaagttccttgaaaatttcaaaagtggcctattttcttgacttttctattggaccgtgagttcctagagggtgatgcagggagggggaggtaccacgatgttcactgtgttcttagcactttacaccatgccagcagcacaacaggcctcaatactgtaaaagctggttgaactgaattgaatggaaatttaatctaacccctctcagagagatgagattcggtgctattttaaaagatctaggaaggaaattccagtttttctgactcccttagctcattatattaggtactgaaccacatcctacagacttggctcctcttttgcctttgttttgccatcaggatttgctgagagttactgtgttcatgaaatcttgccacattggctccattttcttacctaaatatgtttctcatgctattcttaaaagcattagtgatcttgttgggagccaagtagctcaattctgtttcctgccctttgttgataatatgtttttggaggaatggatcaaagtggcttgaagccactgtcattgttttgccttctggtctgctgtgaccaaaccaaaggatggcagctgtgaggacgtgcattgttgtacgactcagttgtcaatcggaaatttgcatacttgttttccctttgtatatcactgaatggctaccatgtgcaagaggctgtgcactgtgctttcaggaaataaagatgaataaggcatgattcttgacaccaaagagctgattttctagaaaaggtgctgtcatgcatacatgaccactatacagggaggttaatgagtggaactggagtcagataaaacacacttgttactatgcgaagaagaatccctgtaggtgctgtctctggtgtatattgctaatgctgttatactgctaatgatgttataatatatgtgttttaaatgtcctcatttacaattaccaaagcaatagataactgctttcactaagttttcctgcaagtaactcttttggctttgttttaaaagttcctttaggctgggtgcagtggcttatgcctgcaatcccagcactttggaacttcaaggcagaaggatcatttgaaacctggagcttgagaccagcctgggcaacatagcaagatcttctttctatttaaatctaaaaaaaaaaaagaagttccttcaaatttaaaaccatgttagtgatttaatattcttattaatcattgcaacctcagctctgatttgtgaatattctttcaaattctacgataaaagtgtttcaacgtatacattgttcttatctgtggtactctgagaacttcaaattcaatggaggagcacgagataagatgaattttattttaacttatcatccatctcctcttagttattatttaattattaatttggaataactcctttgtagtaccattttgatattgaatagtggaattaccatgctggatgtgctgttttgtgtagccatctctgtgtgttggggggctatgttggtcttgacattcccaagtgcagatgatgttgacatatggtaggtggcttgcaatttaaggttagtgattgggtagactcattaagtttacgtggtaggtcacagatggccattttcagatgctataggttgtttatgctgcattctcttggattttgaggaacttttgaaatgctgctgtcagtattttaaacggtattttaactttgcaaaagataccagtaaatgaattagtgtatgttgaaatacaggtagtaattttggaagttcttgagatgagagtagataggggaaggaacaattgcaataatatattttgttcttcttggatggacagagagctgaaaagaactggcacagcctgtggagttgcctggcaccagttggcaggcttgtggctggcctaaattggtacccttagatagagagactgcttttctggactagtagcccaaactgaatatactgccaagtcccaaagttttgaaactagaacatggtctgataatttctttcctggccttggtactttgcagattgccatagttcttggtagtagaatccacctggggctagtaagaagcgtaagaagcagtagagtgaggtggcacctctcctgggctacatctgcatggcagaagtgcttatttctttctcaggccacagaggcagaggtggtgcttgggataggttacatctctatgtctcccacctccaggcagagtgagccctctgagcagtgccatatgttttcctctctggcctttcagacagtccagtttcacagcaagcttatctttttcttgtaaatccttaagaaataaccaacccatactctggcatcttgaatttttttcaaattctctaatgccacaggcataaaggtccaagtctcaagataccacgggccatggtttagtccactatttcactattaaatagcgaagatgatcatcttgtcagtccaagacagcaggtcctcatgcctgtgccttagatcagccagtttttgctttttggtgtattatttagaacacttcacttcctggtaccagtctcttactaggtaaaatgctttttgttgcaaataatagaaaatacaactcaaacagcttagacaataaagagaactaattggcttacatcactgaaaacttgagagatgggagcaagcttcaagtgcagtttgatccagaggtttgggatgtcatccaggctccagtactaataattctaggtaattttctttttctctttttttcttttgagacagggtctcactctgttgcccaagctggagtgcagtggtgcaatctcagctcactgcaacctccacttcctgggttcaagcaattctcctgcctcaacctcctcctgagtagctgggattacaggggtgtgccactaccgcctggctaatttttgtatttttagtagagacagggtttcaccatgttggccaggctgatctcaaactcctgacctcaaatgatccacttgcctcggcctcccaaagtgttgggattacaggcgtgagccaccgcgcctggccaattctaggtaattttcttgccctgtcctcctccatgtgtcgtcttcctcttcctaccaaccctcctcatgaaagtagagatggctgcagtagttccaagtgtcacgtctgcaagtcacgccatccagagacagagaacctttgtcctggtatttgaagccacagtctcaagctcagtcacgtgtccagccttgaatcagttacactggctagaagatgagaatatgttgattgacttagcctagatcacatgttcatttttggtacccagaacagcatggattccttgtgagggctcttggaagggaggaggtagatctataacagtatgtgtccaacaaaaagtatccccagtgctctacatacattctcatttaattctccctagagccccatgcgaattcttctaatggtttatggaaatgtggagttagcaagtgattctgaaacttgtgcccatggtaagcacatagctccttcagagaaaaaaacaaatggatccttttggtggagcaaatacatgaactaatttcattgacatgtcaaagtgaaccaaaccaaggctagagatggtggtcacaataccagaaaccaccataagaagatatggaaatacccccacaccgtttccttagtgtcctatttttaccttgagaatgaggtaggctgtcactggatcttctcccagtgtccctaaatgctaaaaagataaacaaaacaaagcaaaactgtttgcatgattcaatgactcttggtgtcaccttttcactgtggcttgctttattgtattttggtttgcaaaatacaatattcagaggtcttcactgtttaccagttacctgtaactcagcatttcttttgcactctattcctctttggattagaaagttgggatgaggtgtaaaaaattagatataaattccacattggaaaagatggtgaagcgggtaattacagagaaagattggctgcttaattattgttacctgcagggaagctgtgttgtctttctgcagctgttcctataaatagactatatacaggaatccaccccagggcagagttcctctttgcttaatttaaattgctggtttgaggtagttatttttgaaacccttctcaggttgacttcccccttaatccctaagccttcttccctcatctgccaaattatatgtaatgcatggcagctagagtgcttttggcattacatggagcctgagaacttgaactttgattcaaatgttaatttattgtggacaaatttattgtgacaaatggtcctctccctgtgcaagtccttctgtggactctggctctggcttcaccgtctctgtggctcctgctgcatttccatagcatggcacgtgcctcccaccctcatcagttttgttctgaaacagagcccagccaacttcaaaatatacagagcagttctttgggccgacgttgttgagttttagtggtatctgggacttttctttctttcttttctttttttttgagacagagtctcactctgttgcccaggctggattacagtggcgcaatctcggctcactgcaagctctgcctcccaggttcaagcagttcgctgcctcagcctcctgagtagctgggattacaggcactgccaccatgcccggctaatttttgtatttttagtagagatggggtttcaccatcttggccaggctggtcttgaactcctgacctcatgatccacctgcctcagcctcccaaagtgctgggattacaggcatgagccaccgcacctggcctatctgggactttttgttccaggtgtatttggcttaaaattataaaaaacatacagtaacaaaaaagttactctattgtttttctttttagtgttaaatacttccttattttatttatgggagaacctctcataaattcatcttagtctctcttttttggcttttcatagccaaaaacttgttttaataggatcagtaaaaaaggatatgtttgtgggttcatataaattgctagtaattaataataatgaatttcttaattactagcccttcctagttctctttaaaccagaccaactaaatgtagtttctgctgcttctacaagacctactggatgttctagactagaagtgggggacatttgtttaagttgctgagatttcagtaaggacaccaacctttataagacatagtgtgccgaagtgactccttaataggaagaatcaaatgtcctttccactcattatcagtggcaggtatatatgtaagtatttattagtattctgaagtgtgattgagtatcagcacactgaagttatataaaactggcttctacattagaaacatttagagagaatggcccagatgaatttagttttaccattttaccatttagttctggtaatattaggaaaaataatacagacacatgtgtgcatacacacatatcccacacactcctatgctcagaaatttgaaagatttttagtactcttgacagtgatcagattggaagccttggggattaccattctgctgttgggtggcaccatgcacattagtagcagggtagaatgctgcctttgtagcgtgcctctgtttccacttggtagattttcacattgaaccaaagggaaactgtagtatttctggtctgtttactgcgtgttaatttgattctgctgttatagtggcatgtctgttggtacaagaattaaaaacgtagaggccacttttatcaggttatgttatactggtagcctgtgatttacaagtgggttgtgttcttttctttatatgtcagtattgattgtctggaatgaaatttcctcccatagatgccatgttagacgtggtaattgagttctttcacatcaaatgcaaaacatttttaagtaaccatagcaagtttcataatctctgagcttcaattttcttatcttaaagtgggaatgacaatacctacctcatagagttattgtgagggttcaattaatgtaaagttcttggtatagtgtctgatatgtggcaagtaaacaacaaatgttagcagcatcattttttatcatcttcgaggaagcaggttcatatagtctgacattggtacacaagggctgagggaaagtaggggtgggttaggttttttttcctccccctggagttttgcgactctctgctgaggagaagaccatggctttctagtggctttttctgtaggtggacttcaccagggaggatggactgggaaggaggttcatttgtggcagcaggttggcaaatggggcagctgcagccaagtcagaggctcctgatgtggttcatagggaggagaggttatgacattttttaaggctagtgagagtcatttggagctaccagtgttggatttctgcagtagtgccaagaacctatttgaaattattttgctcgtttaaattgacccctttccctctcttctgcagctggagaccatggccaaaatggaggtgaaaacctcacttctggacaatatgattggagttggggatatggttcttttagaacctctcaatgaggagaccttcatcaacaacctcaagaagcgctttgaccacagtgaaatatacgtaagtacacacgaaggtcatctgtaatgtttagactttgtattttgtgccagagagctgtcttttcttcctcagactcttctttcttttttctctctgtttgagtccagcagtatttgctttataccctcagaaagagttgagtttttactgatttagcccatgagtaatgtgggttagacaagtcagtctgctttctgtgatcaactgtgtgcaagtattgtagtgggtgttgggggcattctaaagcaagcagaatactgccctctgaggaatttagaaggaattttgaaatccataggcatcttcttggataccttcataagattaacaaagtctaatcagggagaagctactcattgaaatgcaaggcagtaaactgtcaaaaaagacatgaactttctcgacatttgtagttagtagggacaggagcagattatcagataaaaatatgtaattggtccctgaagatttggctatagtcatgtcctactgtacaaaagtctaatgccatatacataaacagaagcataaatatgtatatgctataataggagaaaatttcctgttgtaaaaagtctttataaaggatttcacagggtcaagttctctaaatattttaaaaacatgaataaaaaatacatttatatgcagcttttctggagtttgcataaagcatctgcagaagtaaaggtgtactgttaactaaaccaaagaaatgaggcattgattccctgtacctgcagctgagaaggaaacagaatgttttggatgggagtagttttagtggactctgcctcacttcctgagttctctttcctcctttttaaaatgtgcatctgtgcatggagaagaactggattattgggcatgcttaatatttttctgtttatcattctagggaggaagtataaataaataaaagagataatacagtgatacaagtaggatcagttataacttttgtggaactaatatattttgtaaaattatatgcaaattatgagctatattattttatatcatagatagctctcttttctagatagccaactctctttatctgttggagctgcgataccaaaataccataaactaggtggcttataaacaacagaaatttgtttctcaacagttctagagtctgggaagtccacggtgaaggggctggcatattcagtgtctgatgaggacctgctttctggctcacagatggcgccttctaactgtgtcctcacatggtggaagaggaatactccttcataagggcactaatcccattcatgagagctctgtccttatgacctagtcacctctcaaagccccacctcctagaaccatcacattggtgactagctttcaatatataaactttagggagatagaaacattgagaccacagcaccaaacatgtttcaaggatgattttgagtaatgtatttatgagatagtagtcatcctctaggaattgaccttttcattcttctcactttgtattggtggaggtgggggaaggttgatggtaacaagaggcctgtgaatactgcttttggagtcttaattggataactggatactaaactgaaatgtgtttacagttcagagatgcgattatttaaagtgctgatccaaatggaaaaggtataaaacactgctgcagagcagggggtggcattgtttggcttggcagtactgcctggtgtcaccttccctccaagcgtagcagttctgctttcaggtgggaaagctgagggttctgcagctttaattgaaagtatgctctgatatcaaataaaagacagactttaaacattggtctttgagatggagataggcagaatcaattatattgtaactaacgttaccgatcatttttctttttggctctgagaagcacaattcacttttaaatgaattgaaaataagatggagagtagaacattacgtgcattcaaatacctgatttgttgtggccactaaaaataaaacaatcacctttttaacaaaatgccaagtgttaacattcatgagtctttagcagacgaaatgtctggatttcagctctatgtaattttattttctaaacgtcctttgtgtttataaaacaaaagcagaaaattgatttcagcttccagatattcatatcaattaatgtttttcatgataattcagggctactgtttccatgagatgtgtgcctttgttttgtaacttcaaacacctcatgttggagggctgggcattctctattataagtgaaacaagagattgtaaagtaatgcgtatagtatgatccttttgtaaaagatgtgtatgggggtttacgaatatgtacatatgtttgtatatatttgtatgtacagagagacaggtatgttaccttcaggtaccatagtggggtgggttgggatagggcatggggacagggaaggttactcttttagacctctgtattgtaggacttaagtcaatcatatattgcttttgtaattaaaaaaaagctgcatgataaatttgattaccacactctccagccccacatgccatgtattcttccctggtgaaatctatttctggctcttatcctgataatactcctgctttgcctttgttcatgggttgctgcaaagttgtctagcttgatgcccaaggctaagttaatatgacatggaacattttactgtcttctgcttcactctgtttttcaattctttccaagaaaatgaagatgcagttaaaaaaaaacatcttttaaggtcttatagcttcattttatattataaaaatgggtgactctctagggatgatccatcatgtgagcatattgaacagtaatttgtatgtttagagctatgtctgataagggggccagtgaacaggaagacccttgccccagacttttgaactctggatctggatacacccatagcctcagcaatctcctatgtgaaccagctctaaatcggggggttcagttctaacatcctgccatccatctcctcttctcctccctcccccaacatatttagaaatgaaaaatagtctgtatcttcccagagctctcgtgagggattgctttgcccctgggtatgagttacgactctctagaacattcacaacccctagtgatcctctggatctgtagcagctgacgctggaagcagactcccttgtcatcctgtcgtactaaacctgaagctctggatagagcaaggcattctggagttagttggaaatgtcaggtagtgttagaatgtgctttttgcaagtagccgtcacacccacatttattcacctgaaaatccagaagtcattctgctttcacaattggtttgatttagtggctcagtggtatcactaaggactttgtgacttactgtctgctttgccttccttggctgtttctttgttctgaggcttcatagtagcaaaccagctgcagcattccaggctttgcattcccgcatcgcgctggctagaagaagaggcagtgctgcttctcttctggcattccaagtcagagtcctgagatttaccttggttaggctgccggagtcacactcccttctcaaaccattgactgtggcccggagatggcatgacctgagcgacttaagaaagtgatgtttaagattggagttgaaccagatttttccaaagtagataggctgtatgtgagggggtgggttcccaaccaaatatatctattcacacactaagaagagaaaaggggcagtggatgccgaggagcccactcactgtgaactcctcaccggtttggtagggagttctgtaatgaagtggcttttttgatgttgatgtcatgttaaaggatgtgtccatgggaagaattggtcacttgagttctaggcttcaagtgcgcccaatggcttgcttctcagacttttctgctggtgaacttctaatggcagagaagagtaaacagcttcccccaggaactctggagcatggtcgaagtcctgcttcagggaaattttgccgaaatgtttactttcaaatgtaattcaaagctttatactgttctctagtgcagatgggttgttttgaactaatataccccttgtaaccctttgagtaagttgcatgctccagaaatatctgttcttcactttgaggtgggttgacacacttgtttaaatagcactggattggttcatagccatctgtggcctggttgagtctctaaatctgggacagtggcagatattgacgtggtcttcgcagttagggcttgggctattcagttggagatggaggaggatcaggtgagatgagatgggggaaatgctgaagtgatgctgcaacacacagggtcagagactctatttgctttttattcctccatcttggcggagtgtggttcaagctgggcccagctgcaggacatgctgtttggtctgacaggctccgtggggtcaatggctgggaaatgctggtcgtgacgttcccgagcactgcttttctgtttgctttctgtcctttgtcagaccttcttccggcctcccctccccggcccccaggccagatggatggtagcaggatttcatgtggacttttattgtgatgtaggagatggcagagctgagatccggccagacatgttctgtttttagggtgactggtcaggactgtggttctattcaggaacaggaaagctacaatttaggcaagaacaaggcccagtacaaatttggaaaccagagaaccaaggtgtctgttctctgacgagaagtatatttggtgctgaccagtaaatttagtttgttttctatctgaattgtaagattggggatcatctagatataggggcctgagttagtctaatttttagatcttatgttaaactaattgtagttgtaggagtgactactttaaaagtataggaaaagttgtcttaagttatagaagttaatactagaattaggattcccaggatgagattagatacttttatgaaagatactcaagatatagtaccatatatttgatttaaaatattgtaaagttaatgaaaacaatactgattaacacatttatttgaagtttcaaaaccacttttcatttatacacatgaaaatcccacctcatgggtataatctctgttcctgggaatttggcgtagatggagtagtagttttctcttgctacaaaataaagtgcacagacttagcaacttagaataacatacgtatattatcttgctattcctggggtcaggagttggggcctggcttagctgagtcctctattcaggattttcccagctgtagtcaaggtttcagcagggctgcaatcttatctgaggcttgaaccttttgcaggctcatggtggtggtggtggagagcagggctggagttcagacaaccacctgagtgttattcctgttactcagccctgttctccaagttttattctttataaaattttcctttaaaggttttttaaattacaaaataacaaatgcttttgggaaaaaaaaatttcaaatagtacagccagacatatcataaaaatgtagttttctcccttcagtaccacaggcccattcccagcgtgaacagtaattaatagaatgatgtgtaatcttcaagattatgttgggtgaaaaaactaattttcttgttctagagttggaagtaggaggaggttctcttttatctagacgggcagacctttacccaggtaatccagacccaacagagtttgcatggaacaagagcaatctttaatgccacctccaatcccacttagatgaagtagggaaggaaggaggagggatcccagccctgttaacatgaaatgcctagacttggttgtatgtgagtggtttaccatcagtagtgctcagcttactctgatcgctgcaaaggtagaccattaaggtaaacattgagaacaaattgtgtgtgccttccagagtgtagctttggtgtttgaaacggagacacagctttagaagcctagataaagctgttgaaaaacagcaaatcatgagggtgaagggaaatgtcatgtctaatttctgagcaccatctatctcttggacagtcatttttgctaataacttgccagcttcaacccatgcaaactttcctacagcctttggtgattggaaaatttcttcctcttagaattttcaaagttgacacatatttgttgcttaccaaacttagagagttttttcatcatggaggcactgtatagggcttgaaatatttgtataatacttacagtgcattaacttaaatattctggttgaagctaaacctaaggtttgatttgaagaaattaaggcctgacatcagatcttttggaagcagtatggtagcactaagaagcaaaaacttgacgtctagtcctggccctgccacttagtgagacctgggacaagttaactccttggagactgttttcttattggttggtaaaatgataaatgataacaaaggacatttttgatttccttattggtaccagctgctgttctaagcactttacatgtattattcatttaattttcactagagtcctatgtactataggtttttaaattatcttcattttacatatgaagaaaccgaggctcataaaggctaagtaactgtccacgatcacacagcaagtaggtgatggagctgaaactcacacccaggaagttcagctgcagagtccatgctcttaatgatagtcctgctgactttccatggttgctgtgagcatcaaaggatactactgatacaaaagccctttcaattctcaaaataattgggtatgatattgaagaatgtgtaggtttggaatgaggcaatctgaaaatgacctggacaaataatcaaaatgataatcagtattcctgccatgtgttgagctgctcagcagtgcagtgacatgaaccagcgtgacatagagcaaggacattcatttctaaagtcataggtgatcattacatggtgctctcaattcaaaggaaaagtgatagcagccatgacaatgattttttccccactgtggaaggtgggagaagatactgggaggaaagtatatttcatcatgttcacaggatgacaggtaactgacagctgcacatggctcttcacctttatgagcacgagagaggaggaagaggaagcagttcggcacaggggacacgtggccagttaattctgtggccagttcaactgtcccctctacacatgcatctgtgtctgttgtatatccatagtgcagaaaaattttaataatcctaatttctaaagagaggctattttgttgttcaaattctgctttggaaggagtggagggtgaaatgacatggcatactgggaaaggtgtgagcttttggctgacagacctgtttgaaccttggtgacttacagtcactgtgaccactgtaaggaatagaggttctctcacccataaaatggtcatcgtggtacttatcttgttgagttgtggtggggattaagggacatcttagtccagtgcctatcacatgatgaaagtggagtgcatggtaggtgccccgactgtctgaaaaacttggaaatccagaatcactttttttttgaggtttcagacattgatgttttctttttttcgagacagagtctagctctgtcccccaggctggagtacagtggcaccatcttggttcattacaacctctgcctcctgggttcaaacggttcttctgcctcagcctcctgagtagcttggattacaggcacatgctgccacacctggctaattttttgtacttttagtacaaacagcgtttcaccattttggccaggctggtcttgaactcctggcctcaagtgatccaccagcctcggcctccgaaagtgctgggattataggtgtaagccaccaagcctagccaagaccctggtattttcattagttagattctttctcttctccccttccctgcctacttctttccctctttctgtattcctttcatagcagttcctgtgtttcatagcagattcatttttgttacattactactttcaattaaccacagaaatattattttaaagacatattgtaaatattatccctttaatacaggaccacaggaccatgctgttaagagagttttattaagtctggagaatggtatatatttggaaaatacttgtctcgtgacacagtttgtctcaacgaagatatggcagtattgtattatcctgctctaaaataaagacgcctgaggtgatatttttagccagtatttcagcgtggcgttgaactcatatatagttctttaattcatagtctgaaatgactggctgcagcccaggaacaagagtataatatgatggtagtgtaggcacgtcttggactaggcagcagagactgtgcctgacaaacttgcggccaccgtcggcagccacggtttgcgggacgtcctggcctctgaatgagctcctgacccaaggccagtgatttaaggcacaacttagataaaaagatgagcaaggctagattctttcctcaaactttgaattgagaaatactgaaaaaataaaatatcaatgggatcaagatgctgagggtgatgaagtcgagaggagtacatgataggccacaggcaaacagaacctatgaataagaggctttgaagtggacagccgatggagtagaaagtgagggaaccagcttgcagcaggcatgaaagaaacaaggggagaagcagagacatgggcaggggcgaggctcattgataccagaactggagaggaaatcttcacaaacttgggttgtgttggttcatgagccgtcctggacccatagtcaccctcaggtcccagatttgttatagcctgggatagttgtcaggggttcctaggtgagttcattaatacaggaaatggacctggatgccaagcagctgaaagagcctgaccaagtcactgttctccgtcctattgtcatagtctttgatgcagagctttgggatgaaactctgcttctgccactgatttagaaaccttgggcaagttatttaaaaccttctaatgtttccagttctattcccctgtaaaattaggctattagcatcaattttatatgtctattgcatatgcatcacaaatatgtttctgagactggcgacatgagatgcatacactgaattacatttttaaaaaatataaggcccagatagacacctaagtctgttattcaccttatacttgtaatttttacttaggcattttgcacagttttgaactatgtctaaaaaacaaccaaagtgtttggtagaccatactgtgtctttaaaaaaaaaaaaaagaccgaggccctctgcaaggaaatttgggaaatcttacagatgtctaattaaaaacaccgtggcatatgacatcttaatatcttgtgatcaaattcccagggtctcagacccaggaaggaagtagattcctcatattggagtgaatagcatgttgtcatttttgaggattcccactggtctgtcttgtatagtcattttcttagtatcctagacttttaatattagttttattaagacataccttatgtgcttatctgaaaattcatcaatttcctgtatacaaagaccattttgggttgggtgccgtggctaatgcctataatcccagcactttgggagtctgaggcgggccgattgctttagtcgaggagttcgagaccagcctgggcaacatgatgaaaccccgtctctaccaaaaatacaaaacttagccaggattggtggcatgtacctgtagtcccaggtattcaggaggctgaggtgggaggatggcttgaacctgggatcggggctgcagtgagccaggatcgcaccactgcactccaacctgggtgacagagctagaccctgtctcaaaacacaaaacaaaacaaaacagaccattttgtaaaagtttttaagacgctggtgtggtaggactcattaatgaatttagccatggtattaacatattttatgtagactttcaagtcctgatttggctctttacagtagccaatagattccagtagagcccagctaaatttatataattataataggtaatatttatggaatgcttgctgtgggtcaggtgctgtgtttgatgttttgacacacaacctcatttaatcctcagaattagatgagggaggagctagtatgcttcttgtaaagatgaggaaactcaggccaggcgcggtggctcacgcctgcaatcccagcaagttgagaggccgaggtaggcggatcacccgaggtcaggaattcaagactagcctggccaacatggtgaatccacctctctactaaaaatacaaaaaaattagcttggcgtggtggcgggcacctgtaatcccagctactcgggaggctgaggcaggagaattgcttgaaccagggaggtggaggttgcagtgagccaagatcgcgccattgtactccagcctgggcaacaagagtgaaactccgtctcaaaaaaaaaaaaggtgaggaaactgggatgtggaaaagttaaataatgtgcccacgttcacacaaaactagagaattttgccagctaatttggagccaagacttacacaatatttcaaatacattgaagaattattattatgaaatgacataggtagaatctgagtaaagagcttaaatactatacttaggtcagaatgatgtgggttcaaatcccatcagtttcatcatctaagcccctcatcccccactgacttttcacttcaaaactgcttttggactcaagctcagactgcttacgtgaagttcaaaggctctctacagtttgatctcagtcttttttttttttttttcctggctttagcaagaattttttattccagtcgtaactactcaggggatgtctttgttttagggaagctgttccattctctgtctttggtatgtgcttgggtaggcctttgtgcctctgtctgtgttttaatctgtattctagcatgtgtcagaattcccttcctttttaaggctgaacagtgttccattgtacgtatctacattttatttatctattcatctgtcgctggacacttgggtgacttcctcctcttgggtatagtgaataatgctgctataaacatgggtgtgcagatatctgtttgagtccctggcaaattgtacttaaaaaaatatattttgaagaagatagcttagcttaaaaaaaaaaaaaagaagaaagaaaggtggtggctgggcggcattcagctatcacctgaaacctaacgtcttatgtcactctttggggggaactttgtccaaatcatgcccatctttttagaccgctcaagctgtctgtcttctctggagctttctcggacctctgcagttcatagtgacctttctttatataaccctggagcactcattagacagtaaaataatcagactaatggctcatttagccaggaatcacatcctgtttcatctgttttaatgtctagagaagttaactcttaaattttatgtttctctatctaaaagactcacttcctaagctatattataaacttcccaggcacacagacactgggagctttgtatttttcctaccatgcccagcatgatgttttgcataaagttagcccttaataaatttgttgcttgcatgtaaaatggtttgtagcctaaaatcactctatcagtcagtgcgattgtgcagccttgtgatgggttattcttacctgaatcctggcccatcctggatttgaactatagattggtgcaaaagcaattgtgatttttgcgttggaagtaatggcaaaaactgcaattacttttgcaccagcccaatactttagaggcaaaagtaacatgacttggagacccttggagatgcagacgactcctataccttctctgatatttctttgatgttattttagactaattcgtattaagatatttaaataaatattgccttttacatcaccacattcctgatttatttctctgaagttaaagaatgattacgattgaatcttttctggtgagagcaaacattttccctataactagaagatcttttccttttctgttttgtttattcctggcggtagaaggatttctcaggtggtaaaatgggaggcttttgcctaacagagtagcgctttattacacaaaggttgaagatgctttatatggcattgtgcaacacaagtttcctccgttcttcttgcgtgctttttaccaaagcttcccaggcctaacagacggcatggattgtatgctctaatgaaaagagaacagattcttgtctccttgtcttgatttcacttctgctagctaatgtggtcgtatcacttaacttctttgtgctcctttgttatggacattaagatagagaatttgtatctatctcttggggatttgggagtagtttagtagaaaggtgtgtatgtgtatattctatgccagctgttcaataggttgaggatgagtttttaaggaactccagagacatgtaaacaaataactgaaattcatcctgaagaaaataaggaagcaggtaggtagacagattggatgcctagttagagcccagcaaacagaggctttaaaaatagattttgagagaattcgatatttcaaaaaaagcatcaaagtacatgatggcaaaaataggtcattatgggattttcttacatgtattttatggtgtagttatacattttaatatcatatgagaaactgaaatgtaaaccttcaggatttagggcttctaaagatctctatcttaccctgggaagaattatgatataaaagatattaaaactattctgactttttagaagaagttttatatacagacttggaaatattctgactgttctgtgtatgtgtgctaatgtttcatttatctgcctttgcgaaggaatgttacacattattgagacttacataatattaaagctgtgctaaaatatttaactttttggttagatatcattctaaaatgtattgcatatatccttgtcatcaaaaacagaatacactgattttggctgttgattattaccctacgttcccaattagtgccataataaagcagtcagggccggctaagccatggggctcttgggtcttactataaatatttttatactttgataattatcttcatcacttcttacttattttctttctttctttgtccctccctactcttccttttctattagtggccattgtttctctgcttgcagagggagtcttaacctggtatatcacatgtatgcagacttcaatgtgcatgtgtgtttttccaaggagaagagtcattgcttccgctggtgtctcaaagggatcaacaattgaagaaaggttaaggagtgctgtgtagcacaattttttaaactgcaagtttcatatcattaattgctcatgaaaatcatttagtgggttagggccaacagtttttaaacattttgtaaaaaatattagaatcgaacaaaaaatatcaatgtatcacatatagtaaagggtacttttggttttgtgaagtttttatcttgtatatgtgtgtgcacataaatagacatacatacacatacctggttgtgatgaaaattttatttcttatatatgagttgtaatcaaacatttcaaattcacagctatagtacggccctttttgcctcttccaatatacagatgttgctgcagtttttctgtagtctattgagactatgccaagtttattagaaatgtggctaaaatgagagtgaggctagaaggacttttcttttgtttcagaactagttccataggagtatttaaaggggaaggtgaaatagaagataagccaacagcagcactagcaggttgttgcaattgagagtaaaacctggtcctgtgagtctggaagggaagggctacagacattggttttcaaccctggttccacattagtttatgttgggtctctttcaaaaaagtactgacccctggccgttccctacatcattgaagtagaatctctgaggattggagttctgaaagaactttcttatagaataaaacacgtggcctttaggttatattttgactactcaaaggcttttcgtttggcttctgaacagtggtctggggagtggaggtggctagattgaatgtcctccagaaaagacctctgttttcatggtaattatgctaagaacactcaagtattatttgattatttacaagacatctgttttggaatgctagagatacttgaaatctaggaaggtcgagatggttttgacttaagaatgtttgtgcattcttgattcagtgtctgcccttgagaaatgaaatataaccttgctatctgtatgtgccaattatagaaaggtagagcttgttttcttctccctcttccctttttcttctctttcattcttgtttgcttctcttccctcccacatctctttcctttcttttcccttcctgggtgtcagaggctggcccactgagcagaggcatagagggagctttccattgtcatattagtggtggcatggacctgagggcttaggggagctgaggttcagaaacgtggaggggtgagcctagaaatgcctgggctggttacttcataatgagttggtttaccatcctttttagagcgtgatgcaataagaaaataccaactgtaaatagtatgcagttgtttatttaaaaaatgacatctgattcacaagtccaaatgttaatcaatgtaaaaatgaactgtctggtcactatcattctgatccttgaaaaggagatttaatctggtgctgtagtcacctgaatgtagaattggtagctacctaaaactagagtagaaatgttaaaccccacccagcaatcagctgctatcaggaatgtctttctgtgtctcagaggaagcagagttgtgactgtgaacatttgagttattctactggcccatgtaggaatatttaaacctttggctaatgcacatagaactttgaggaagaaatccataaacagaaagggcaggtataggatgaacctgttaggagttcaaggttagaagataaagaggatatctgaactgtataaagtggaatggagagagaaagcatagtttcttttagtgtttgcttatttaggtggataaaacttgtcctgcttggcaccatttttagtttcttgagtcatgtaggtattgatgaaaagagtcaaactctaaaatatttaaagagatttattctatgccaaatatgagtgagcatagcccataacacagccctccttgggagatcctgagaacatgtgcccaagatgattgggacattttaggcagacatgagacttcaacctagagaggtagaacagctcgaagcagtgaggcttccaggttataggtagatttaaaatttttctaactggcaattggttaaaagagttaccaatagaaaggaatgtgtggattgctataagaggttgtgaagaccaaagttttatcacacagataaaacctccagatacccggcttcagagacaatagattgtaaatgtttcttatcagacttaaggtctgagtcgatgttaatgctggagaggtataatgaggcatgttcgacccccacttcccatcatggcctgaaccaatctttcaggttaaattttagagtaccttggcctaggaggaagtccattctgatggttgaggggccttaggattttatttttggtttacataggtgtatcagttactgttgccatgtaacaaactacctctcagaaattaaaggcttacaccaacagccaattatttgctcacgattctctgggatagcaagttagcctgagtttagcattgtatattttctgctagtctcacctggaatcactcatgtggccttaggcatctggtgtccttactggggctggatggtttaagatggcctcactcatgtctaatagttagtgtagcaggctgtaggtcaggataccttagctctccacaggacctctctgacaggctagctcaagctcattcacatcatggcttccagccacagtcataaaaaaggagacacatcctaatacacaaatgcttctcaggcttctacttgtgtctcatttgctaacttccctttggttaaatcaagtcacagggagaaattccaattgaaggagtggagaaaaaaactctatctttaaagtaacaaagtcacatttcaaatgggaagtgcatgcagggatggaaagaattgttctggctgtttttacagtctaccagagtcaaacgacatttagggatttgttaaatggtaatgttaccggaaaggagtcccaatccagaccacaagagagggttcttggatctcacgcaagaaagaatttggggtgagtttatatggtaaagtgaaagtaagtttatttaaaaagtaaaggaataaagaatggctactccatatgcagatccatttttatggttatttcttgattatatgctcaataaggagtggattattcatgcctccccttttcagatcatatagggtaccttcctgatgttgccatggcatttgtaaactgtcatggcactggtgggagtgtagcactgaggattaccagaagtgttctcatcaccatcttggttttggtggatttgagttggtttctttactgcaacctgttttatcagcatcgtctttatgacctgtatctcatgctgacctcctacctcatcctgtgatgtagaatgcataatcatctgggaatgcagctcagtaggtctcagccttattttacccagcctctattcaagatggggttgctctggttcaaacacctctaacagtaacacatggcatataggctgattaaaatactaagcactgagtatagtatatttgatcttatatttcaatgcaagaataattagatgtgtttcagtggcttgtaccctccaattagtgatgaacataccccatgtgatttggtcatttagttaacaaatatttattgtacatcatggtgggccagacactgttctaggtgatagagatgcagctgggggaaaacaaacacacataattcagtatgtgtaacagtcacaaggaacaaagagaaacttacaacttattactgtggcttttgattttgaatttgaggcaacagagtttgttccctgtgcaagaatgccacagaggcagatttttatcaagaatttagccactgtgaagtttggttttaaagagcaactcagtaagtggtttttctgctaacagcaaatcaatatattttagaaactattgtattcaagaaaaagggagaaggattcaaatagtacttttctacttaaagaaggttgatttttttaaccaatagatgttaaagaaataaccaatggctatattttcatatttaccaaggctactaattctaatgtattagctggaagctattcagacaagtattcagtgtcaggcgtctcccatctgatgtttgcttgtgacattgtccttgggagacatctcccatctcctaggtgggttgcagtgtgaggacaaccagaaaaccttgagaaagttttgtcattgtttgtgaggccagattaattgggtcctagtgatagaatgttagaaataaatgtgaaaaattgcatgggaactgagagttttcttttacaacagcaatcttgtccacccttgacaagataatatttgtccacctttgacaagatagtattcttacaggatgaaagtgtgtttatatatatatataacctgttcagttttcctagttgggagaaagtccttcataattaatatcattgtgacccctgtaaaaagaaaaaaaaaagtcagcagaacatttctacgttccttcattttctattctgtttaattttctagaaatatctgacagtctttttgaatcccagtggtggtaatactggaaaaacttgttgctctaaaaatggtaccttttgtgggatgacattggaaaggtgggaagttggagatctttttttccccttgtttctttctttcctttatgaacctttttctttttaaaagttatatcgctcatcactttatcacttagtttatcactttaccacttttgttggcaccttttttccccctcctgtcttttatgatgttgaaactgaaggggaaaatggagctgccaagataagttacagttaagtgacgtttgcttgtggcattgtccttggcattgcacagaaggaactaaaccagcaccactggtgctgccaggaatttagggtcgaagtagacaggaagagaaattgtgttctggtttaaagttcagtgagaaaagtttagtacatgctaaaatatagcactgatccctcagaaagtgcatttaaattttacattaaatgtaaatttgacattaaatttaaatgttgacattaaatgtactttctggaaagtacctttaaatttgacactaaaactctgatattatgttagatataatgagattatgtggtttgaatgtccaagagatacctgtagctctgatactgaattgaacgtgatctgagcccattgtggaaagattgacagacttgcagagggccagtgccaaagggaaggccctatgaggtgtgggtagggaagaggggaacactgggatactgttgactaaaaaggtggaaaaagatgagagaagaaggggaactatagctctatctagaatcagggagagcatggctcttgcttacagttagcagtagtttgtgacaaaatttgtggaaaatatgacagggctttggagaactcttaccgagaaccgtaaattagttcagagatatactttgaaaggattttaaatatataaatgtatgctttccatttatcaacaaactaaatagacattgttgaccatctgtcttcagagatgcaaagcattcttaaaatgtatacaatgaatggtgaagcagaactagtgttgattttaaaaggttgaaaccatacaacactaaagcttaagacgttaaaatacattttgtgtactaactaatgggcatgttttgttctttcttttgcagacatacattggaagtgtggttatatctgttaacccataccggtctttacccatttattcaccagagaaagtggaagaatacaggaacagaaatttttatgaactgagccctcacatgtaagtactgtactaaagcattaagtttctcttttactccagagatgtgtagttgacagatgtgtgcagctgtctcctttgaatttcagaataatgtttttgtcagttttttttaaaaagtttgataaaagtatgaagactttaattgttattattttaaattaaaaaaaggcagaatacttcatttgacgtcagacttttctgaaatatttggattcaggatgtaaaatattttctgttcaaaattctttgcaagtagcagctgctgctaattatttttgcaaataaaacaggaatgtgcattgtttattattataaagagcctaagcagctttttcatagtgttgttgggccaagaaaaatcctgagtgttgggttgtgtgatggtgtttgggtaaaaggaccaaacaataccttcagtttgtaatttttgcagacaatgttcaccagatgcgtgggataggccagtgatttcacttactctggaaagtcacttgtttgatttttctgaagaaggtcacttgttagtgtaaataattccttcacagtacctgtagattctgtttgtctgctcctttagagttcttcgttgacgtgcttaagagatgccgaaatgatttggccactttataccactacaattttgttttctagtctgaatgactgaaacataacactggaaaagtttgcctggatttggtagatccgtggtagaaccgggttattcaaccctagaacttttattcctccaaataaaaatatctgaaaaagaaagttggagagagaatacccagaaattatcacaaacaataccttaaactttttatttctcaaaaaacttttttatttattcttatgttacatttactgattcaagacaaatatgttcaccatttacattctcatgtccactactgagtttaaaggaaagagaaatatgctaagttgggccaagtcatgtaatgagttgagagcctcagacttctccgcttgttgcttaggcagaaacatttcctgcctcctctcctgtgggcatgcaagcatttttaccagaattcacgtacttatgattgtcagttgctgcaaggggcccacggtgtcttgcagacgggagttggttgatgcagcataacatcttttatgcaataaactgttgaatgcagatttagaatatttgtgaactgctgctgaacgtgggctgggaataacgtatgcaaaagtgccttggaaggtgtcaagcattctacaaagttatgttgttcgttattaccaccattgctattactttttcgcagtagcatcatcctctctctctcaaaacagatgatatgctgaaaacaaccccaaattgtcatgaaatgcacataaatacatgtgcatgtagatattgatgaggaaatgttcagtaaatgtcttggttgcggaaaagatttattggtcattggcatattggtagcggggcatttgaaaatggttaagctggcaatttgggtcactttagagttgagacattttcagtctttttaccgaaagcagtagtactcaaaatggggcagtttaaaaccccaggggacagttgacaatgtctggagacatttttgattgtgaaactgggggtaggagggtgcttgctgccagtgggtcagggatgctgctaagcacccttcaaagcatatgcagcccttcacagtaaagcgttgtctgttagccgtgtccatagtgccaaggttgagaaaccctgaaatgaagtgaaagaacctgcagaaagtctcattatgtcctagcagaaaggattttctctgtatgattaaagattggctttattaattttgacagaacataaaatctaataattaaggaacatatatataccactgtccagatgcttgttttagtttctcttgataatgcagcatgcagcgatatatttgggctgtttggaactaaagattatttattatttaaatgtatgaaaatggttattaatgaataaatctgctggtatattttaccagtcaagcaaattctgatcattttgttttcttctagaagtagatattgcaagtgttcttgtttcattttgccttaagacaaataatatctgaaatttgttttataaagttatcctgatagttaagcccctgtgatgaaatactttatttgatacctgaatattttaaattctagtcctcaaagccccacttctcaaagtatggtgcttggaccaattgtatcagaattcccccaggggcttatgaaaaaatctggattcctaggtcttacttctcataagccaggaatctacatttttcacaagctttctgggtgattcttaggcgcatgtaagtctgagaacgtgttgctttagatctatatttaagatgtttttctttcctttcttaactacttactgcaatttgtgatctttaacaataataatagtaataataaaagtatttatggctaatattttattaagtacttactattctgctctaaatactttatacgttttataactcatttcattctgaaaataatcttgtgagataggcactattacaaatggggaaattgtcacagaaagatcaagtaacttatccaaagccacacagctggtgggagtggagccggggtattaacattggttgcccctcttagctggaaatgggcttgccattttcatgacagggcctcttcctgtgcacttccaccccactacctttggttcgcctgtgttcctacaccacaaaccctccaggataatcttgactgtgcctcagtttacccccagcaattgtccacatgctctttttgcattttcagctttaatctccattctgggaatgtttagatatataatgtttgggtagatagagaatgtttagaagtctattctaggtcatagaagttcatgctccagaatatacatttttatcctggtgcctggaagattcctgtaggaggcagcatggcactgctactctagttcacacccctcacccccaaggaaaagaaccaccacgagcactaaaataaaatacattctcaatgtgcttaggataaagaaaatgactttttaccatggcctacaaagcactacgtggtgagcaaagtacagttttactaatgcatctgaagttgccagatccctctcattccctcccatcttgcttgttctgtcagtcctcaccccaccctcaccacattccctctcatgggagcatccttgcatagaattctgtgccttctgcctggaatgcttttccctctttctccaaagcaactcgtgttcttccttcagacctcaaattgcagaagacctcttagggaggaaccgtcctcacttgttccgtactaaggctagatccgttgcttttgccacatttactatttaatgtttgtttaagggatgatttgtctaagaatttgatgagggttcagtaaaaacatagtgaacaggacttgggttcaagtcccaggtcttccatttacaagctatataatcttgagcaaattacttgaaaaacttcaactcagagaaattaagtaattagcttattcagtgggaaaagaattattaattaactcctgggatttttgtgagggccaaatatgtagttgatatttagataatgatctaatacgtataaggtgcttagcatggaatctgccataactctgtgagaaaggaaagctatttctattaacaatgagaattatagcaattgttgtaataataaggtatgtgggacacatttccaacattctcacatgctctgtctcaccactttctgcatggtgggtcattttccacttcctttagtgtattttcctgcatttttctttgcagatgttcatctttgatggtattttgaaacagggtcaatgctaacttggttccctactaaaacagcctggcattctcaaacaggatgtttgtgatgtaagggggtaagatgaccttagcttttgatgcattctaactgtaaatatttcatgaatttagttccagtttgaatagaaaacaacttaagcagctgctcagactacatactttgaaaactttgccaattaacttacccaatattacatttgaaatttacttgtcaattttttttttttttttttgagtcggagtctcgctcgctctgtcgcccaggctggagtgcaatggcgcgatctcggctcactgcaacctccacctcccaggttcaagcaattctcctgcctcagcctcccaagtagctgggactacaggtgcccgccacgacgtctggctaatttttgtatttttagtagagacaggttttcaccatattggccaggctggtctcgaactcctgacctcatgatctaccctcctccgcctcccaaagtgttgggattacaggtgtgacactgtgcgcagccttttttttttttttttaagagatgaggtcttgctatgttgtccaggctggtttcaacttctgggctcaagagatcttcctacctcctgagtaggtaggtgggactataggcacatgtcactgcacctggcttacatttggaatttaatttgagctgtgttcactgttagtctgcaaaagcatccagatacttttgtaattcatatgttttgaaggtgtctacaatttatctttctttaaattttaggtaattaaaaaataattccattttgtataagtatatgactttcagatcgtggaaatgtatagattggtttcctacctattttcctttcaaaaatagctttctgttatcatttgtgggtctgttagtcccccaaacatggaactcctcagctggactcctcctctgcggctcctttccttctctgaactgtccccgttacgtgtgaagccacatctttgagcagggtatcactgggtggcatccccaaggaaatgtggctgtgctgtgtggcagagcctataccaccatttgcttttctagttaggtaagtgatgtctttccagtatgatttttaacttctttgaaaataaggaaggtaaaaaatgtattccagggaggacatttcagaaacatttcagaaaactcagtaactggattcattgagaactgcctcagattcccaaacagcattgataaggaaaggctgagaagggagagatgagggaaataatcaaactataggttgagcatccctaatctgaaaatccaaaatcttaaatgatccaaatcagaaactttttgatcacaacatgacaccacaagtggaaaacaccactcctgacctccaaatgcagtcaaaatgcagtcatgcaacatagaattgattccgtgtccctaagagaaaggtaaaatttccttcaggctatgtatataaggtgtatattaaatataaatgaatttaatgtttagacttgggtcctatacccaagataattttgtatctgcaaatattcccaaatctgaaaaaatttgaaatctaaaacacttctactcccaaacatcttggttaagcgatactcagtcgatacttaatctccttccacttagttgcaatagcactgtgacagtgcaccttcagatattttagttaccaaatccactggccttttgtgttgggtgattgccttttaaccttgcagcagttgatgcagtttatcaccaacagatggatcttctaaaatcagatcatgttactcaccttcctagaaaccttcatgggctccctattactcccagttcctttagtgtagtgttcaaggccctttacagtccagctttagctgtcctccctgctctcctccaaaccccactactctcctttgtggaatctcctcttgagccagagccattcatgtcttttcctttctacgtctcataccctgtaccttatctccactgttaaaatcctgccagtcttctatggtctgtctgaaagacttggtcagccccagcataatccacaagggacttgcactggccctgagttatcagaccactcgtggtcgtcaacacacctcttcttgctatggttgattaggttttggtgtcaccctcttgaatgagatagaagcttctgtaggttagaaactttatcctgcacatctctgtggctgtctccagtgcttttctcttcagagctcaacaactataaaacaaaagagattttaggtgatttttcattacattttacctgtgttatggctgagagttcaatgaaatcaaaatgtacttgataggatacttgtggagtttattcaaaatttcatgcagtataatgagaatttttttcattttttaaaaaaagcaaaaatatttttatggtgctcttcaactcttaagtatttgttcagcttcgatttgttcatgttgtctgtatgtctattggaaggaacttgccaccagaagaagagtgtattgtggtacctggcaacaagccctctggtggtcatagcccaggagtgagctgagatgtgtccttcttaagttaggatataatgtgatggccatattaccttaggcattgcagtcacaaggtgaagcagtctttccatgttagtaaattacaaactcagcaacaaatgttaaaacttagacaagtggcttacagctttgaataatttctggttaccctcatttaaaaatgggtaagcaattagtgggagcacctggtatagtgctaatgtcagttgtccagaagtgagccctccgtctgtggactctttgacccctacttttgggccagactggtttttcaggatcacataccgttgcccatgagtgatgttgctataatgcttgtgtgttttgagtctttgttgatcctgttaccattttactccattcaaggtgaaccaaagtaattttataaagaacatttctgactatatctcaaaatgtaccagtgctgtggttgagtatacagaggttaggttaagattccagggcagaagactcacacattatttcttttatgtagtcagttttttttttctgcaacggagttgaaattctgtgaattaaagctgtgtttgagagctcttattgcaagtagattctgaattctcctgtagaggttgcttgtgcaactggatgtgaaagtgctttctgaagggtgtgtgtgcgtgtgtgtgttgatgtgatgttgctgaggctgttgtgttatttctttcattttacttttggaatagttgagcccttaaattgatccagtacgtctccacaaataagttgcagaaaagggttttatgctttcccatctagcattctttttatttattactgtagaagagatattcatttactgagcaaatatttattgagagcttaccctgtgccaggcagtctttcaggcactgggatacagcagtgaacaaaacagataaaattcctgtcttcatgagagaggctaaactccagcttaagtatttagaagtcaagattgtacacaccattggttagaagggaaaaagggaagagcagaggaagggaagctttcatgaaaaaaaaaaattgaatcttaaaggatattcttataaaaccccctttgagccatatctaaggcagtttaagtcagtagatgacagattgtggtctgcaaggctttgcatctgtccaggcctcagatctacgcaagtagcttgtacagaaggggattagagctttgtttgctctccagtttagatgccttaaataaacatctcgtgtgtaatgacaccatcttgaaaatagctaaaattacccttttccttttatgcatgactgtcatgggtcaaaataagcagaaggcaggcactgtgtttgttgtcagtcttgggggatatttgtttgattctggacaacaaggattagaaaacttcttgacttaggcgagtttcatatcagcagtgcaatgtccatgtggtggtcaagctctgctgttgacttgaagcttcctgaggctgggtctgcagtgggaaacatctctgggcgtcgcacctaattagcttctgtaaatgctccacgaactgaacttgctgcctttgactttcaaagttttcttcccagtatgttgctttttgtggctattttcaaaacagcttctttcagccgggcacgttggctcacgcctgtaatcgcagcactttgggaagccaaggtgagtggatcacctgaggttgggagttcgagactagcctgaccaacatggagaaaccctgtctctaataaatatacaaaattagcctggcgtagtggtgcatgcctgtagtcccagctactcggggggctgaggcaggagaattgcttgaacccaggaggcggaggttgcagtaatcagagatcatgccattgcactccagcctgggcaacaagagcaaaaccccatctcaaaaaacaacaacagcaacaacaacaacccagtttctttcaggatatgtactcttagcagaaagagacctcagctaatttttcttccagatcatgaagcttttaaaactcaagtaggaaggttgatttgatgccagcctaatgtttttatcatgaaaattgttatgatataagaatacatttattaattgaaaagtgtttctggtacatctgggcagtttcagaatcctaatttctagaccctcaattagagtttatatcccttctcaccaaatgcacatctcagactcgaaagagtttattgtaaaaatgctgtttgtgaagccaagcctatgttcacaccggcatacacgataatttcagtgatacaatcttaaagggaaaagtttggttctcagcaaaacagctgctaactgccaagatgtggctgacctttgacagactctgagaagttctgcaacatcctggaaaagatccatttcatctggagaagcagcactgaggccttggctgctgaaggattagtataattacttcatccctgacagagagagccacagttggaacccacctgggaagccttgtctagggaggtgggaggggtgctggccccaccctttgttgttgaaattggaatctttgccacaatctgttgctgggactggtgtggcagggtaagtagggccaaaggagccctgtggggatttgtctgaacaggggctgacaaaagctggtccccatccagccagcccagggaagttagcaaagccagggataatgaaagtgttcagcagagcgaatatgaggccctagtcgtgagactgcggaactgagggtggtgatggggccaccacaggggtagaaactcacgtagaggggaacaggcccaggcgtaccagccccaggttccagttccagcctgtcccagggatcccagatccccaagtgcaagtgattgttcattcatctgataaacatgattaagcatccacaacatgttgaggtgctgggaatacaaagatgaattttcccttaaggattcacaggctggcgtgggagacagactgataaataaataccgaagggagaaagcagccataaaaaaggtggggcatgtcctggtttgccctgggtagccctggtgattccttttgtagcagcataattattaatagtgctcttggaattaacagaagagtctgagaatgagcagtaagtggtgtggtcccctgggaaatggggtacagccctgcctgaggagctaggagatgggatggaggacccttaggtgatgagtttgccgcatggataaagaataggactctaggctcaggagagaattttctagtcagagggaacagtgttgactcagtcattcatcatacgttatttgggtgcccaccgtgagccatgtactagtgtacctactggggacacaatggacaaaaatcttggcctttttgtgcttacattctagcacagagagagacaaaacacaagagacgttaataaaacaaatggcattttaaatggtgacaagtgctgtggagaaacaacgtggggaaggggcatcagggctgtgggggagtcacgagtggtttactggtttaaatagggtaaccagggagtgctttattgagatgttatatttcagtatcatcgtctaggggtaagagggagagacgtgatgtgttgagagaagaatgttctaggcagaggcaacagcagatgcaaaggtctgaaggggagacagaccgagctagaacagcatggcacatcagtgatctaagttcgtgtggtttcctaaggttggaacctagggtgcaaactgaggatgggcagatgaggtagaagaggaagagcagacccaggtcacaaagaacttttgtgctaaggatttttaagcaggtaggaggagagagaatatgagccttgggatttgaactgctgtgggtgtacagaaaaagagaaactcaacgagaggtttaggtttagggacgtggtaggcttttgcagtaagggacaaggacagaaggctcatctgaggatgggagggacactttagaggcaaatccataggatgcagtggctgaacagaaaaggtgaagagagagggagaaagggggatcagagggagaaagggggatcagagcccagtcacaattcctggctgggatggagaggttcagagtcccaggcaacccctggaattgcaatagcctggagatagtcttgggaagcagtagtgggtacctagaaaagcatggctccaggtaattgacagcagataattgtatgtttctaacatcatttctgataccaggtgtgtgacatttttcccccagcaccaaccagttatctgacactaactgggtgtccaacagttcagtttgtttactggaaaggggtcccccaagagagagttcttggatcttgtgcaagaaataattcgaggtgaatccacagagtaaagtgaaagcaagtttattaagaaagtaaaggaataaagaatggtcatttcatcccatgaacagagcagccctgagggctgctggttgcccatttttatggttatttcttgattatatgctaaacaaggtgtggatttttcatgtgttttccgggaaagggatgggcaattcctggaactgagggttccttctgtttttttttttagaccacgtagagtaacttcccaacattgccatggcatttgtaaactgtcctggcgctgctggtagtgtcttctagcatgctaaagcattataattagtgtataatgagcagtgagggtgaccagagggcagcttcctcgccatcttggttttggtgtgttttagccagcttctttaccgcaacctgttttatcagcaaggtctttataacctgtatcttgggctgaccttctctctcaccctgtgactaagaatgcctaaccttctaggaatgcagcccagtagatctcagccttattttatcgcgcccctattcaagatggagttgctctggttcgaacacctccgacaaactcagttctgacactaactacacagttagcacagaccacacaggtcaaaggcttagtcctacaagagtgccccacttcagacaccagccatgaatggggtaccctgactactcacacttctgcttagtcaaccccacacgtttgggggtttccatgatcctcaggttcaataatttgctagaacaactcacagaactcaggatgatacgttttttaacatttactggtttattataaaggatacaacacaggaacagtccagtggaagagctgcagagggcacggtgggggtgtgtatgcagagcctctgtgcactctgggaataccaccttcccagcatgtcagtctgttcaccaacctagatccctccatctccccaaaaaaacagaattgtgttcaaatttttgtaacccaatctccagctcccctcccctccctggaggtggggaggtggggttgaaagattcccccccactctaatcacaggcttggtctttctggtaaacatccctatcctgatgctactgaggggccccacctgagtcccctcatttgcataacctcaggtatgggcgaaagggacttgttatgaataatacaagatactcctgttacccaggaaattccaaaggctttaggagccctgtgtcaggaacctgagacaaagaccagatacatttgtttttataccacagatgtggacatgtgtattatacattgttcttaagaagccatagaaagcttgtcctgaaatactcgaatcctggcttcctgaagccaggttattgttggagtttctgtatacaattttagaaagctgaattagtaggccacctttttccaagacatgtttaagggtagcaacagttcaactcaataaacatttgagtgttgtgtgcccaggatcccattcaacccctccaagtcatttcccctgtctactgccttatcttttttctttcttcttccattcccaccaacataacatgctgcaatgtttctcttgatttcacatctcctagctaccatgccatttgtttcctttattaccaaactgtttgaaaagttgggtatgcttattgtctctagttcatctctttttcttttgtaaatcactctaattgggctttcatctcccactccactaaaacttcttttcaagatcatttgtgacctccatgttatcaaatcccatggtcagttttgaatcctcttcttcctttatcagcaacatttgacaacatgaccagctccttcctggaacccttttaaaatttggctttctggcctccacattttcctgtctttcccccgccttgctggctgctccatatccagcctccgcattcccgtggcaagtccaggggctccactctgggacctttgcttttttcctctgtaggcattatttagatgagcctacgtgggcttcaaataccctctgtgtgctgatgatgcctcccggatttagatcttcagctggatttctcgcctgacctgcaggcgatccagctatgttgagctctgcagcatctctttggataaggggcatctcacaccttagcacgcttcaaaccagacttaggattgccccactccctcttctctttctcaccttggtcagtggcagcatcatcctttggttactcgatgcaaaactgtttttttccttttctcctattgcacactcagtccatcatcagcctgatcatcctaaccacgtccatagccacttgtgcgtgtgccaggccactaccctcctttgcttggattatgttggtggcctcctcactgtgtccctgcttcaactctcctgttgcctccgcctgcctcccctcaaccgccaactttcttatcttcatgaatgttatggccactgcctagagtgatcttttttaaagatctccatcagattgtttttctttgctgctcacaaaacctgcagcaactcccttgtggcctgcatggctccacttgatctgggctctggccacctccctgactgcatttgttacttctcaccctctcttccccagccacgctgtcctccttgctgcttcttgaacatgccactgtcagcatcactcttgtaccatagaggggctgacttgttctcttactgcaatcaggaatagcaatccctgaaatagccaagtccttccccaatcacctgttattctcttaggctactttatttttcttcagagcatttgtgcttacctgacatcttgccatgggctcattttttgttactttattgtcttttgcattagaatgtcatctccatgagcacttgcgctttattttaccatccctgtatccatagtaattagaacaatgcctggcgcagagcagccactccataaatattggtggagtgagtgaatgaatgaatagattggtggggagtgggagagctgctgttggttagaaactgtagaagacatggttttgtctttaaggattgtccattctagttgtgggttgggggtagctacataagctgcattttaatgtaacagtatacttacaaggaacaagttggaagtgcagaaaaattggtgggttcagaaattctgaagatgccacttgtgttgagtcttgaagaagaatttttttttttaagacagaatcttacactctcaccaagtctggagtgcagtggcgcaatcttggcttgctgcagcctccacctcctgggttcaagtgattcttgtgcctcagccacctgagtagctgggattacgggcatgtgccaccacgcctggctaatttttgtatttttagtagagatggggtttcaccatgttgaccaggctggtctcgaactcctgacatcaaatgatctgcctgcctcggcctcccgaagtgctgggattacaggcatgagccaccacgcccgacctgaagaaggaattcttgaagtaggtggcttttgtagtttatagaagataagacaaaagaccagttttggctatggcataatgaccctgaatgttaggaaagggaaacggtattagagttgagaatgtagagctatttttcaattttaataaaacattccaataccaatctgcttgaatcattgggaagactgaaggattatgaaggttattccaaagtaataggaggagagtttgggataaggaaattacttaaaattgcaagctatgtgtctggaaaaattgccatcttgcatttcagtcatgaactggaaaaaattttcagacttgttaaatatgcctaagtgtatatgtgtgtaaatgcaattttttaatgaatgagtggtgaatgatttaatgttgaaatgatataagtgtaaacagatgttaattcatttgttttacaacagaatttctagttgctattggtgatgagtcacaatgtaatttaggaaggggcaacatttgatatgaagaatactgattttaacctttattaactcttacgaaaccctttgaagccacccccttagtatattagtgttcattggatgcataggtgatcagcttgagatccaaaaagaatatccttgtatcctcagttacagtaggaacttcctaagccttatagatgacttagcctgctttcacataaatttaacaagagaggaataagttagagtatatacattttctactaatctttttccatcagtccacatcaacagccaaaacttaggctgttttagcacctggagggagagatgatttggatggttttgcaccacagacctctaccttgggaaaacacatgcaggcataatcataggttacctgcggaaggtcttaggttactggcttaagaccggagggtttcatttttacttttatcctctatattttcatgaaggatgggtcactaagggcccttggatgtttctttaggaattgctagtttttaagccgttgctttgccttcgaaagacatattttcacactcatacaccctacctcacgtttggccatgcagtgttgctgctgcttctatctatatttataattggtttggccgttattaatagcagaagcttatgcatatttttctcatgtgaatagcattatggattaaaaaagggacattcaaaatggcagactctcatctaaggtcagggaaatgtattaaagaaaagtgttactgaagtataaagatgttaaaggcataaattataaaatgaacacatgtagctatttaagattacatgatagagtgagtcatggctatctggttactcattacctggaatgtgggtatagggaaggaggaagtgtggaaacatgtgcatgggtgttggtcattgttcctaaaacaagtagaaaatgatatataacactttgaacatttgcctcctttccgtaacttaacataacttttattataagaatattatatctatgattgattgttaatgtcatactttgtcttacaggcatagcttaggtagcatagatgcattttaaattttgaaaatctttgtccttttctatatttagagactttaactttctttgatgtttacaaatatattgcattgatctttaataggactcttaaaattaaagccagcgctaattaaaaattctggctgtgaaaatagagaaattgagttcgataaatttgtagctagtgatcagttatacattttttttcacttggcctcttgtggcctactgtttctgaaatcccactgtttgcttcatttctcctctttcacagacactctggtctatattctgttttactcactccacatattcaaatcctgctcatcttttgcggtatatgggaaaccacctccattctgaagcctcttctctaaaggccacttggtggtccaaacacatatggtccatattgtgcattctgtcacaaccatgaccttttatttatatatgatttttattaatcatatgacttttatttatcttatgtatctcattgattgtttcctatttaagtattagacttctacaatagtaagcatctttggaagagggactatacatggatactttgttgcttcaagatcagtggtcttaaaatctgcctgtgtttggttatttatagttaacttgtcaggtaacaccatccaatgtattgtgtgtgttataaaacatacacaagactgggaatttttaaaaagtgatgaatacagaaatataaatagaagttctgatgtttatatttgtactccagtggctcatcttgggcatgccctgggatgcccacacctcactttggagacctggcattaggttcatagtaagtattcaggaaatatttatttttagccttcagctattctgtgctgcttactgacaaaattcccacctattggaaatgaaacttgagtttatagtctgagtgtgtttgagaccttgtaagggggtataaggaacgattagtcagaataaggtaggttatttttgagtggcaggccttcctagctcaaggcataacacaacaaaggtttgtttctcatgaaacacaatttgatgggggtctgttgggttttctcagaggctctcctaaaaatggttactcagatatccaagctgcttctatattgtagttataatatctggcacacatggctttttttttttttttttttttttttttttttttttgagacggagtttcactcttgttgcccaggctggagtgcagtggtgcgacctcagctcactgcaacgtctgcctcccgggttccaggaattctcctgccttagcctcctgagtagctgagattacaggtgtccgccaccacgcctggctaattttttgtcttcgtttttgttttttgagatggagtctagctctgtcgcccaggctggagtgcagtggcacgatctcggctcactgcaagctccgcctcccgggttcacaccattctcctgcctcagcctcctgagtagctgggactacaggcgcccgccaccacacccagctaattttttgtatttttagtagagacgggctttcaccgtgttagccaggatggtctcgatctcctgacctcgtgatccacccgcctcggccccccaaagtgctgggattacaggcgtgagccactgcgcccagcaattttttgtatttttagtagtgacggggtttcaccattttggtcaggctggtcttgaactcctgacctcaggtgatacaccagcctcagcctcccaaagtgctgagattacagatgtgatccactgtgccaggcccacatggcttttaagattgctgtggaaggtgaagagagagcatgataagatcttcattggccagtgcatagtcacatgggcccagcctaactgcgaaggaagctgggaaatacagtctcctcttgtgcccgggaagggagaatggaatgggatttagttaatttatcacatggtctcttgtctgctaggattatttcagtaaggttgttggctgtttggtaatttaacttgtggataccatgtaaagcaagcttctgtgtgaatttaaacatgagttcagtagtataatttagaatgaaagacctcttaacatattttcaattttttaaaaaataataattgtaatcatggtgaatttccacatttccagtttaattttatttgaatgcatttctacagaagtaaaactgttcatccatttttcatgtttctgttgttactttttttctttcacactattgttcaacagacttcagtagctttttggtttattatcaataaagacttttctaatagtgttatagttggttgctattgcttacagaaatagttgatatgtgattattggtgattatttgaagatgttttagtgcattggtaatttattggagtagatccatctttgttccaattctcatattactgattttcttggaaccaatatgtctgttggaattattagaaaattagatgttggtctcttctatattcattcacatattcatccattgggaatttcagtaaaatggttctaaccagctttgaaacttaagccaatgcaatgttaatgtttttggattcaactcttcccagatgggtgatgaatacataaaagtcagtttcccctatattcaagaacttaaagttgtgtttaaggacaactttaattaagttcgttttccacatatgactatagtcaaagatagaaggtgaagaaatatgaaaattttagaaaagattacagaagaatatttttgttaagaaaggagaagaatattgggttttcgcaggtgagatggggaagtttcaggttattgcgtaatgcattaagagttcctatttccataatatgagtcagggcaataggctttcaaagcttctcttgactcagtggtgctatatttttaaattgtagattttttattctgctgaacctgtgtgtgtctgtttgcatactgaagatttttctagatttggtaagagttgcaaatgttacaggtgtaagtgaatgaacaaaaattatctgggcaaatttttagctcttcttataagggtggtttgtatattgtgaggcagattcatccacacccccaccccttatcctcccaccgtccgtccgtccatccatccatccatccatccatccatccatccacccatccatcttcccatccatcttcccctcctccctaaaagcaaagctcttcttgtgtgcatatattttagtcataccaattgccttttttagtttttatggttcagatacatgtgaagatcaatgtgaattaattgttatattccccactttcaaaattatcttccctactattcaaaatagtaagctgcacagtaagctgaccaaaggcagcttagtattttatagtcaatgtaataaaataaatagctttctaaaactcagagcaaaggaaacatagaaaatagatgagaccccagtgaaagttaataccatgacatcttctaagcttactgaacttgaacttttcatttcctggtagtcaaagcaaaaaagggaaatgtgatcagttacattatttttgcatataagaccaaagtgcattgctcaaaagaagcaaagttttctttgccaattagatttcaaagagatttctcctgtgagactgactatgtgaagggtgtcatcatgacaacacctcccaaaacttagtaatgcattttagatagctaattctcatgttactaagtggaagcagcggacataacaccaaagcacagtttaggaaaagcgaatctataaggatttagatttaggaaaagcaaatctataagaggtataagtaagtggctgtcacccttggctgtctgttagaaccagtgcagaattcccttagaatctatagggttggggaaggggaacaaggtttcggctccgtaggtgcctagtatacatctagggatgagaaccataggtacaagtgctgagcttattgatggtttgactcaattaaagagtacaaggaacagatagattgcatatttccttcaggtgccttgtagttctgtgaaagttttttgtgttcatttatttgttttctgttttctcataaatgggctttgaattaaaggtggtcttcagataattggaggttttattctctggtaagggcttagagtacacaatttccactgccaataaaagatccttaattttaaaattcattaatagattggtctgccttcattttatgaaaatttaggaagcaaacctagacttgtttgaatagatggcccctcatctctacagagatttctacagagattaggggccataagtcatatgataaatagaaagttctccagactggaactgatttatgataatgattcccagtctttgggcctcgggagttattgtagggattgctgttttctcaatcagtaggtatttgaagtacacatatttgaagagaacagtcatatgtgagtgagtgtgtgtgtgtgtatgtgtgtgttttaacctttaagcaataaagctagaactactagtctagaatagttttagaaattggcatttcctatttgacaatttataaaaattttagggatgtcttcctttagcaggtgtttagcactaaaatctttggagacatgtgccttcattccaaatctctgtagattttcttctctgtcagcaagcctaccattggcatatagaaagctccagtgagggtcctctggcatcatcctaggacttgtcactgagttgattggatgtgacagcatgtcagatttcagtggcaagaatggcatggaggtgagcagagggttgtcactgtagcttttctaggcagtcttctagcaatttaatttaggaagatttaacgtgtggagtctttgaagatgtattcattgatccaggaaaattttgagtgccgcacctctgcaggtttcggtgattttgttggtgcagaaaacttgttctcaacataaattcggaacactgaaagtaatccttctttggaggaggacgtatttgatttgcggaggccgaaggggactgtgataggtagctcttggtagctttagcaagccatgatggagggagagccttggacttgagtatctggagagcaggtgcagcgtcgtttttatttttgcatcctgtccaatgctgggcacagttgttggcagattgtaggcactggatacatccgctatagaactcaagaaggaaatgaggataaaagtgatacttgttcaaaggggacctagagaactgaccaacagtttttggagacgaaagggcatatcagctggagactgtaagcaaggtaggagggataggagcagcatattctcattagccagctctgaagaaggctgtaattgcctttgctccttagttcaagaactagcaagggcctgcaatgttactagtgcaaatgtaatcacacttttttaaattttattattattataccttaagttgtagggtacatgtgcacaacgtgcaggtttgttacatatgtatacatgcactatgttgatgtgctccacccattaacttgtcatttagcgttaggtatatctcctaatgctgtccctcccccttccctccaccccacattttgacttttaaaaggagattttaggtgactgtttgcctgtgtcttcacattgaatttatacagaccagcattagagagaattgctgaatccaaataacccaaatgaaaaattttaactagagtataaaatagagcctcactcctctttaacttaattcttcgagtattttaaacccacagagctctttgtaagcatatgaatgtgcacttatatatgtctactgaaataacattttatttcatttcctctttgttatttgtaaatagttggcaagcaaacatagactttgaaaatgccatacattaattttatttctttttttgcatgaatatgagaaaaggtgatgttaggattaattacaccagtttttttctgagcatataccatgtgttgcactgtgctaggcactagatggtgagtcttaattcccactctcaaaagaaactgtaaacaaaaaaagtctcccaaacttaaaacacaacatattacacaccatattacaaggctgtaatagatgtagaaataggattttataggtgtacaggcaagggactcctagagcgagctgagaggcagggagttccagggaaatgagccaggaaaaacagcagggccagctctagaggagggccttgcttgctttgtaatctgtagcacatcagtgagaaatcaagcttttaggatttgattctgtatgagtgtatcttgcttggttttgacctctctgggtaaccagaaatcagtctgagtatatagaaatggagctttcatattgaaggtacaagcttgtatcaagcttatattttgtaataaaaatatgtgtactatgtagagctcccaaggacctgatgcctgtctccagattaccctgaagcagtctctgttccgatccaaggtctctcgcttctacccagctgttctgggaggattgtctctagtcttttatcagataactttaagcccctgcagatacgtagtaataaataccaacttcctgcttgcagatccaagtgtttgcttctctcaaaaaatatatatgtaatctgtgtgtgatatttcaacatagtcattttcttgtagccacttctgagatgtattgacatgacttaaaacacttgaagcagtatttgagtgctgtgcatttggatgtgttctgaagcagcactgtctgtgtgatggaagcatgcaagagttgtttgaaaccctttgtgtcagggcactttctgtgtaccaatgttaaatcttcctctagcagtcacatagcttaaagcatggctgtttagtcactccctgcctaaagtccagggccaggctctgactggattggtggagagcatagcaagcttgtaaactgatgagggagggagtggcctctttgcattttaggctaactccagtaaggaagaggagggctgcagggaagagagcctgcaggccgagtggtatatgatatttttgctttacccattcttgtgtgactactttgaagtcattttgttatgcagacactttagcactgaaaacaccataaacataagcaatctcaaataatgtgcagaacagacttggcatcttgagcttccttattgttgaaaccctttacttagagtggcaaccaggacaggggtaagggagggaatgggagtggaaaccatctggaagacacactcacataagccctactatgttgaccatacacagtcctctcagagaaagctgtcagtcactctaggcctggagcctgctcagtctctgacggggcttctctctccatggtctgaatcatcgtcctctgatgtccttttgagtcactgattttctttttaaaattaagacatggatttggctaagtcatgatggaacttacttgttttctatttgaaagtctagaggaagggtttccacattttatctctgttacaaatttgcaaaccttgtttgaataggtacatcataaaccctgggtatggcaggatgttgagcctccggaccacattaggatcatgtcagtcaagactgcccccaaaatccttggaactgctgctaagacatctatctctctggtgcctaagcaaaataaatgcattatacttataatcagagtactcctttgaaccatagttttgggggacagaactgatacaattttgctttgagttctaacaaatttcttacagaaatgtttaaatgtatgaagttaaatctggctacaagggggacaagattaggaatggagaaggagtcatggtaatgaaaaaaactacattttttgacagcattgtatcaagatggcttgtgaaaatgtcttgcttagatatagaaatccccattaagaggttcctgaaagccaaaaatgagagactcctctaagacaatggcaagctggtgatggtaaggaaagggtgactttggaaggtattgggtggctggatgaaagaagaaaagcaaaattttaatcacaaaaacttttttctggtcttagtattcctctcatgctttggggaaaggttttgttgttgttttcaacaggcaacacggaccagatgacttgtcctcacatcactaaattattttctagttagatagtacatgatttctgtaaactgagctcctgagggtagggacagtatcctttgtatgcctctgcctgacactctcctgacacataaaatgtttattgaattaaggagtactgaattatcttaaaattattcccagaatgcttccttctttacagtatcatgatatgaatttagctattaacaaggaagactcttattattcttatttttattattttgccaattcacttttctttctgcacaataatatatgcaagctcagacatttcatggtatatacacagtggtctgtgtgtatgtatgtgcaagtatctgtctatattcaggcatctcattaatattggtagatttaattgaattttgcagccactccatgaaatggctacagatttggttttcctaaacatgaatagattgatgaccttgattctgtaaggcacacccacagattcggcccccacataccttttagtcttgtattgagcacctgctgcatttcagaccaagggtactttatagacatcctctgcacagccctgtgaggcttcaagcacaaaccaaagcttgaagaagttgatagccttttaccgctgcccattttctctcctttatgcattaaaaaaaaaaatcagacagtatgtacttggggttccagttcaaatggcatctctgcctattgccttctgtgataacctgagccagatctctgcacttccacagtatatggtgctattcaggtccccagcacagtgctttctagggcagatggggcactgggggctgtcagagttagaggagagtgttttacatttgactcttgtaaacatgaaagcttcacttaaccaagcagtctaactgtttgggatgtggatatgacgtactttagatcagaatgtgtttctaagttaaagaaaaagtggcatatgaggtgctgctttttaaggctttaaatcagtagggaacatctgtctgtaaaaaatcagcagaaaccattctttttaataagtgcaacattaaatttagcattaagttgtaaaggtgattagcaaggtctgtagagtaacttctcttgggataggtgtttccatgatttatttgcctgtaacaaagtcataaaaatcgatcatgaaattaattgaaataagccatttttgccaaaaagtttggaaacatttgtgttgggaatttgtttaaagtgagccagaaagtctattcttgtagaccatagctgtgtaattcttttaaaaagagttgggtattaaaaggtgattgttagaattcttttgttaaaagagatagtaaaaatgctttaagagcttattgaatttgaattaagatccccaattgcatatttgttcttttctccaaatcaatgtgtttggttaatttctggacaggggaaatagcataatttcctccctgctgtctgcttcctcccagcctctttccttgcatatgcgttggggttcagattttgcagctttccatgacatgcgtctctcagtaaaagtcatcttttccttttctgaatatctttaggagtttacagatatgtttattaccttctcctaccccctttttatgggggaacttagatgtctttcttgttagattttaagcttctagatgacagattctcttaatcatcatcctcagagccctcacagtgagtacaacgcctcttacctcatgagtatccatgaaatcctttgggagccctgctcttctggatgacctcacccctgcttccacatactcttccatttcagttattaagggattaaatcaaggcagtggaagccattcatgcttcattaatttgtgagataacagcctgcagtagcaagggcagataaagaagtagaattagcctttttgcttttgacctcttgccaaaccccaacaggatgctccgctatggggaactttcccccctgtggtggtttcatgcctagggcatttctaggtactgttttctttgaagcaagtttcagaaggaagtcctcagcagcacaagggattgctactaaattccaaagagcggcttccaggccctcaagacagatgtttccttctctctgcttttatatcttaagttcagtccttttccttcctgggataatttagtctctctaaatcccttatctgcttcctaatgtgtgtctccaatacctggcttctgcaatccacctttgaaaaagagtcactctttggcccagttcacattcttaccagtccaatagaaggaaaggtgcttattttgttgagtaactcttagcaagctggtcctgggcggggcagacttgaggatgtccattatgatttgataatggtcaggcctccaggctagaaaaaattttggggtgtccctaagcttctttgtcacaaggattacaaataagagttctaaaatcttgaaagaaaactaccccttgtgttttagattattttctgtaactaggatgtgaactcctgaaataatgagctttgcttatttattctaatgctgaagtaggagagtttcttgtccaattatgtgggtgttacaggaaaggggtcccaatccagaccccaagagagagggttcttggatcttgtgcaagaaagaatttggggtgagaccacagagtaaagtgacaaacaagtttattagagaatcagaggaacaaaagaatggctactctatagacagagaagccccaagggctgctggttagcttttttcgtggttatttcttgatcatgtgctaaacaaggggtggattattcttgagttttccaggaaaggggtgggcaagtcctggaactgagggttcctcccctttttaggccatgtagggtaacttccagatgttgccatagcatttgtagattgtcatggtgctggtgggagtagcttttagcatgctaatgcattataattagtgtgtaatgagcagtaaggaggaccagaggtctctttcattgccatcttggttttggtgagttttggctggcttttttttaaccacatactattttatcagcagggtctttatgacttgtatcttgtgctgacctcttatctcatccagtgactaagaatgcctgacctcttgggaatgcagcccaataggtcccagctttattttacccagtccctattcaagatggagttgctctgttttgaaggtgtcttacacagggatttctagtttttaaaacatcgtaacacatgtgaaccattttatatacacataacattcagatagtatgattttcttccttagtggttacatttgactgccaggattaaagtatatttttgagtgacccattttaaaaaatgtgaaacgtggtatatgttgaggctgacctaagtaatctatgaaatttcacaaaaatattgtgagatctgtgttttgaaaacaagtatgattctaaaggaagaagaaactaaaatgcatattcatcatatcttattttaaagcctgactttcaagctttatttgatggtttactgttgtcattctaaaacagatgtcatcttcaaatgacttatcttgatgatattatttttgttttgtagccagtaaaaacaatccttttccggttatgtagccaaaggaaagcaacatggccacttatgtttaggatataagaatgtaaatgaaattagaaaattacatgttgataaaacagtcttggaaaaaaaatgattgtagctcattttctaagataattttcacctgcattctgccatctgtcatgctatggcatagcatctttgttatattgggatggcaactagggacttctttgagattagatgtataaaaataaaagtgcagtgccttaaaaaaaataagttgttgttgtatggtatgtctttttctattttatttcctttcaacctatctatgattttatattttaaatgtcattcctgtaggcacatatagttgactcttgtttttatattcattcttacattctctgccttttaattgcagtattttgtccactgacatttaatgtaatattcgacatggttggatttaatttgtcattcaattatttatttctgtttcttccctcttttttttctttgttttttgtttccctattcttggcttcttttggattatttgaattttttattcgtataattccatttactttttagttattttggctatagttcttcatgggttgtcctagggattataatataccttaactttttagaatccatatagagttaacattgtcccactttatgtgaaatgtagaaaccttccaaccatttaggtatatttaccatccatctcctcccagtcccatctgttatgtttgttttcacattgttttctttttactgcatagtgcacactttgcccattgtcatttattttgaaaggcttttctaccttttcttgccctgaagcttggactatttaggaatgtttaccagtgttgtggctagcaggggtaactgtaatgtgtacataaattaaattaccatgcttatactggcataggacaagactgcagtgaagccttccaggataaaggtacaaataactataaagacttattttccctaaagttttaccttaagatgtgataagatgaatgtctggtggaagggcataacactaacttgacaatgatatcaaaatgtcaacttggggatattttccaattgggcaaatgtttctgaattaagaatatgagacaattatagatataaagatataaggaaggccaacgtagtgcctctccttaagaaaactcaaggtttccatgcaaaacacaccatacataattccctttctccttttccttctcttccatgtccttgtggaccacctcaatcctgattgggcttagcgtgaagttagaattggggaagcacatggaggttaggcatttttaaaaaacacttttttgggggttagtttagaaacacccagttttaggactaaaccagagctagtaaggaaaagaaatagtggagacttgtatatctcaattgtagatgggaattttgagactgagctattttgagaggtttgaattccaaaggagaatttcctggtgttatttgaaagtactctagggctcaagattaaatgaaaaggaataataccattttgagagcttttgaagaaaatgacttgaaataagaaggtagaaacagttatctaagttcaggtaagtttcctgagacaaatttagttctgttaaacactttggctaatggagaggtccaactaccagttctcagaatggattagattgtctttggagaatgatttctcaagcaactctatagggaagagctggagaggctgaaacatggggccatgtttgaaagaacataagctttggatgtatttcggtgtcacagacatcttttctgctttgcacttgaggtgaaacaaacctaggaaggaaatggcagggtagagaacatggagctttgggaaaagaagccctgccattgtgtctgatggccatgaaagcagaaccactctgacgaacactctgaacagaaataagatgggagaggaacaaaaataccagctagacaattgtgaacatgcaacccagcattccaccgtgacagaaaataacagatgagccccaaaccaaacttctaaaacctaaaagtgatagatacagctgtctggaaacatacttagtgctagggaaagtttggctctcaaagaacagccgtgtagctgatctggaaatgaaggggagatggcctttaaacatcgggctgaccctattcttagagctcaactagaggacagaagaagaggataaaaccatgcccttaatgtggtaggactaaaactgtgtttactcccttacgctatcgtcattatattataattaaccattcatttctctgtgtggtaaataacaatgctgacacggtcacaaaataatgtgaagcatatgggtcacaaccgtttttaactaaagacttctctaaagatttatttaggttccttaattacagagtggcttggaagactggcatgtggtttcagtttatagttataaatgttggagctgatgatgggtacgtgctcttattgccagagagggagaggaacaagattgggagggggtttgtgttctttggggccctcccttttgcccccaccccttgtttttttaaagaaattgaagatctgtgtttataagaaataagtctgatgacatttatactgtccttgagatgggtatgccagtagttacaagcaaatttttccagtgcttaagtactttaattggtaaattttcacgtcactttgaactcagtggctctctagaatcctgaaagaataaatcccttttagcctttgtcttctattaaaattatactctctgttagatgaatgagaccctgtctttgaggacagcagttaagtatttcagcctggatagagaagaaaaaaataagtattcaacttaggttctttgagttaaaatgaactcacaacagggtgatttggtgatcttccaaagccttgtgtttgtatatatgtgtgtgtgtgtgtgtgtgtgtgtgtgtgtgtgtgtgtgtgtgtgcgcgcgccatatatgttactcatttttgaagtaattttgcattattttggaaccagtggtaaatataatgcaaagttgtagccctaggagcatgggaaaaaggtctgtattcaacaatacatgaagaattcagtgagtacgtattatatattggaaaacttcttttgtatttactgtaatgtgttttcctgcatttcttgccaatgatgataatgaaagtggcatctcaaaatattatctgaacattggaggagcagaaggggaggaaggctcataaaaaaatctaagcaatgctttcctttcctacatgaaggtcatagaagaaatgaatttcccattgtttatcattcttcatggagctcactccagtagggactttgccactgcttcgagagcatccactcattcatccatcccttcatttatgacttggtattggttacatttcatgtttatgtctctgtggcataaacatggcataaagattaattagaaaggctctgccctagaggagtttgtattctggtagggaataagaaggtgtgtacataactaattataacacacaaagattttctgacatttattcagggctttataaatttcaaagtgcttgtatgcacttttatttgatcttctaaagtatgtggctacattctccatgttggagatgaagacactgaagttcagccatggtaatgacttgcttgaagtcaagtaggtgttgagatacatctatagggcccagggaattgcatctgagatgttttctgcctctgtgttcattgttttccactatccccattatgcaatggtgcacagactggggaatcagaatgtgagagaaggctaaggccacaagcagctgtgaagcttgagcaaggctttggttgtgtagagaatggttgaaaggcctttgagagacagagatcagtgcacattgttcaaaggaacaagctagaacaagctgttattcaaaaaagaccctggtgtcaggatctttttattactttttttctgtctgtcgttttattcatacattcattcaacaaatgcacttagagtatacagtacttattatatgcaaggcagcagactcactgatatgaaggttacaaaataagactaggggtggctatccttgaggatctcacagtagttcagctggaaggtaagatatgctggcaaataattgtaggagaacatgatgagagagggaagaatgtgattcacagtatttctgggttcaagttatgactcttctgagaatgggatcatgggcttctcatgtcatctcttaagaccatgtttctttaaggaggctagcatttaatttgcaggtctgtgttgaagattaagtccaattgtgaatcctaggacactttactgggctcctggcacatcaaaggtgttcagtaaattgtcattatttatggttccgtatgcctttggaagaaaagccaaagtccttgactggtgtgaacagctctctgtgatctacttggccaaatatacactcttcctgtatcccagtctttcaccagtctcctggctgcagactggttgctctctgcacccttgtcaccctgtggtctatgcaaaatgcaaaggtgctttatcccagtggtcagtcgcaggcgttagctctggccctgctgtgtcacactggcagtggacctcagcaagttatgcctttgctttgtgctggtcttgttgtgagatttaaaatgactaaacgtaaagagcttggaggcagttctggtacatggtaaattggatattattaattccaattactgtcttatccatcctgcactgaagcttcctatcagctcttttgtttttcatttggaacctgcctatctctctccgcagctcatctcttatcctctcttcattatgctttgctttgccttccagctacatcgaactgcacataatccttcaccccacctccatgatgttttggcctttatttttgtctaaaagacatttgtcttgctcattcattctttaggactgagttttccacctcttgagtttctctgagtccattctccacccctttgaggtttgtcttgttctgccatgttttgcacatacctttatcattgggcttaatgtattggctccattttctctttctctttctctcctccttttgacggagaactcctgaaagaaggggtcaagcattaattgtctctacactccagctttttcttgacacatagtagactctcaacaaatacttgttaataaatgaagtgaggactttacctattttaaatacattgtcttattgtcagaatcattttttcaattagctagaaggggcaaaatttactttagtaaattttgaagtggggaagagcaacaggaccactgctctggccttacttgatagaggccctttgtcatcctaaggcagggttagaattttgggaggcttgggctggacaaaaaccctggcaaacccaattttgcctctgatggatcttagagttgcagtcatttgtttgtaaaggcagtagttctgtatttaagttattgtagtaacatcagctatttggtatttgataatatttttcaaatgtttgaaaagatttttttccctcatattgaaacttcagtgtatggtcctgaaaaatctcaacgttatccaattttagacatgtggtgtaacattttctccttgtttgtctgagttacctggattttagtttaacaacccataaatgtagcttgctgggtttataaataaataaattatttatataaataatttcatataaattttatataaatttattaaataaatttatataaattatttatttatataaatagtaaatattatataaaaaataaagcatatcattagagtacaataaaacagtactattttggttaatagagaatacatggaagaaggtaacgtgtcacaatggatgggtttatttatttatggattttaagaattcaaaggaaataaaaggtgatagcttgctttccaaaagcatatcacagtggccctttaaggagcttgtagttccatctgataaacacataataatgatctgaagtctaaggaatttttttccattatcccctgcagctttgccctttcggatgaagcatacagatccctacgagatcaagataaggaccaatgtattctcattactggggaaagtggagcaggaaaaacaggtaaggctcctaccaagcaactctgcagaaggtaaatgctgcacagaatgacaacagcaaagaggaccagtagggcctccttagcaagatctgtcgcagggccactgtgagggtgcttctgcaggaggatactggttaggaacacagaatgttctctggactccccagagaaacaagatgcctatccaaggggattccaaccaatatgaagtctagtgccggattctagacctttttagcgtagtctctggatggtgcaagatctttttacttttctcccaagacattaaacctgtgtgctgttacagattcaaactgcttccccaagaatgccaatttatttaggttttaagagggtacaaacacactctacctttgctaaaaagtgagggaagataccagaaaaatgctaacattttactcaagagttttcctctgaagcctgaagaattgagatttttatatgtattttttagacctggcaagcttcgcataaaaaaaccctccaaatggaagggttatgcttttttccccttgtgcttttaataaatgcaattcatatgattggtggtcttgagtgagaaaataactttacagatggtgcccagctacctggaaaagattcagaagagccacattctctgaattcaaccttagaaacgtttaaagctgctgttatcagtgggttttttttgatggaactgatgagtctgtggaggaggaagatggtgagggagatggtattttcgtaaagtttcatctgtaaaatgcttttgttttatagataagaatatgataattggtcaattattttagtattcaaaggtggaattttaaatgtttctattctacatggctggttagttgtaacatttacacattttgagttcccattgatcaagagaagaaaatctgccataggtgttgagtcaactgactgaatccattttattcacaagctcttagaaatatttgtgccttgaaaggctcactatctacatcgaaatggttttccttctacacctactctttactccacttgccttaggcgtaactcctccctgcaccccatgcagctgaagaaagagtggttagatgaatgtgtccagccccctttcttgagctctttggagacaccgagcaccattgttttgcagggctagccaagttctaggctctaggtggtcagaaatgaagggaaaaggactggcatgtaagagccttaggtaacagaaaacatggtgtcatattgttgaagggattttagttataaaccacctggtgtaggctcctccacatgggacagccaaactccttttgaagtgatgaagtctcaccactttgaatggcacccccctggatttgttgtacaggttcagctaacaaaattcttccttacctagagttcaattctgcctctacctatttgtcttcagtctgctacctggaactttaccatatttgtcttccttctcctctacaggacaatcacttagttatttgaagtcaacattttatctttctagggctaaaaatcccttttcttcaaattttctcattttatacacattgatttaattcattcatccagaaaaaaaattattgaataccaacttagtgaaaggtactatactagggactgtccttgcccttatcacatttcgtttagtaggggagataaacaatagctctttacatagacatatatgcacgtacctatacatccaaattacatgcaaaacataagtggagtgaaggaaaatcacatggtgcttatgagagcacattacaggaagaattggatcttacaaatctctcattatcttggtcctgttgttctggaaacatcctaatttgtcaatatgcttcatgaaattgcataccaaaaaataaacagaatacttgagatttggtcctggttgtagtggaactcttatcctttttctttttgagacagagtctcgctcttatagccctggctggagtgcaatggcgcgatcttggctcactgcaacctccaccctctgggttcaagtgattctcctggctcagcctcccaagtagctgggattacaggtgcccaccaccacgcccggctaatttttgtatttttagtagagatggggtttcaccatgttggccaggctggtcttgagctcctgacctcaggtgatccacccaccttggcctcccaaagtgctgggattacaggcgcgagccaccatgcctggcctattatccctcttaatgtggactctgagcttctattaatataaagcatgtattgactcatactggtctttaaaccaagtaagatattataggatttttttttttttcacagtaacttccattaggtcagatctgctcaatcaactattgatgaacaaaattattttaaacttacatgcagaatattgtatttatttttattaattttggtccattgttacaacctcttgagaagctgacaaatcctgatgctttcccttcccttaggattgctgtcattttgctgggtgataatgatactagctaacccacgttcagcacttatcacgtgctgggcggtgtgcttatttacatgtatgagataagtatttttgttatttcagtttttatgatgggaaaataggaacacggaaacattaagcaatttgccaaaacttatacagtgaataagtggcagagctgggattttgaatgcaggtagtgtagttatagagtccctgcttttatccactgtactaagctgcatctctgtaccttgaacatggtacagagtagttcttgaacatgattctttccgagtgccacactactttgcccatgttggtaagtctccttcaactagcctcccatgtcttcttaagggagggattttgtattatgtttctactacctaatttaatggctgccatacagtaggtagtcagtacatatttaaataattgaatgaacatcatgtactaatccaaggagccagcctcctgtctttatttaagtaattgacaaaaacactgaataggactgggccaaagactgatccatatgaaaattgccaggtctcatttaaaatatgtctatcttactaaaaattagttgatttgcttagttctgggtatctttatctttctccatttttttccttaggcagtctcaactattttccagtaacgttaatgtgttctacatttacactgctagtgaaaatacctcttggctgatctcccagctatgtatttactgcctgtctgacatctctacttggggtctaacatgcatctcagactaagcatgtacaaaatggaactcttgatttctctctttaccctcttataaccaatctttctgatctcaataaatgagaccactagtcaacctagttatcacactagaaatgtttgttatccttgatttcttcctttcctgtatttcccatatcaaatccctttcctaattttgtcagttctggctctagaatatatctcataccaggctctctcttccttttctttttgtccacatggagactcacaagccaccacccattatctctcatgaggattatttgtagcagtgtctaatgggtttctctcctttctctcttgattacccctaattccattttacagaccccagtctttgcttgttcaaatctctctctctctctttatctctctctgtctctgcctctgtctctgtctcttaacctgtgggaaactttacaggacatgggcatcttgagaaaatgtttttaccccttccatgtcactaaccagttctttcaggtgaaacagaatttaattcttagaagcagtacagcttcttgtttgtctctaggttgacaaatgaaaatggtggcaaggcaagttagaaactctgttccttgctgaaggcatctgtactgatgctgtatctacgcccacccctccccccatcctatttgactctatctacaagcacacatattcacttcatattgcttcatttttattttcacttggaagaagaaaagaaaatattcctaagcctctttcattcttacattctttagctttttagtcagccttctttgtgactaacggtttttttttttttaggatattctaattgtatcaattcgttcctaaatgagtcatcagaagtgggttgcggtcattgttttgatgggtcttggccagttcttcatctcctctggaacatgtgttctgagaagacagcacgtccactaattagctatgtcagtatgtgacatccgccttctcagagagttcttaacactactacttcctcctggagccagattccatctcctgatgggctcatgtatcttccttactgaaaaactgagtggaggttgctagtgctgtttcagaggattggcatccatttttcttaggaaaaaaaataactaccaccctatttctctggtagaactctagtagtaaaatggagttcattcttcttttttatagttttctcttgttatttttctgcttgacaatttgttctattggtttcagtgcccaaatcaccacttgaaatcctcttctccttgtcatcttccctggatttagtccttctggggatcctgttgccctttatcagaagctggaaaatggacagcgcttcccagggcttgtcaccctttcctctggtagtgccattgtgtttacagcacatagaattaggtgctgcttcagggaggaggctggaggagggtccaacagagacgctagagcattgcttctcaaatctgtggtgaagcaccagttccaaatctcatgttcatcattactagaaaaatgaaataatagacaaaatagagcatttaaaccttaattttttcttttagtttcaacaggcaaaacaagcaaccaaattagtacagaagcttttaaaagcctacttgcatgtgtagatcacttaatagtctgtggattgaccaacttggagtcgtgctggtccttggaccatacttcgagtaacactgcctagaagtcactcaaagcatttgtgttgtttttgagctactgtgcttcttggaccctgtgatgaactatcgtcttgggtgcttcagctgtctgttatcactaagacgcctggagccgggaggtggataccgctcctgagagtggttcattttgaatacccacttagctacatgcttggtagcacctagcccttgagtccttttcacttatggaacccaacagcttctcctacctctcagtccactgtagacatacagtggtttgctgacttactctattttctttcttttttaaagcagtggtacaaaaactgcttaatattttatgacggttttaattgtctttagtctatcaaattgagtaaagccaagaatattgtgtgttgtttaaagtctctgttttatggagattacttacaggaaaataaaatgatggaagataatatagaaatttcagtatatagttgtacaaggaatttggagtgggggtttcatctcagttttgagcagaagagggatgccaggccattttgaaatgtcatatcatcttatgcactaaaattgtttttgtgtacatgtgttcattaaaaattttgatttagtaaataaatgaaagaagatgattaacatttattgaaggcctggaatgtgctgtgtgcttgacatataatatctcctttcaataaaagtctttacttaatagtttgtatagaaccaccatgtagtattagagggcttattttataagaagtaattaacttaactgggtcataaaccctccttggcagatgatgatgttattggtcttaaacattggagacactcttaagctgcggagttatgtaacatgggcacttagggagaggcgtgaactcttttgagtcctttggggtgctatttaattcattactgctgtgctaaatgaaaaattcatcagacctcataaaagtgcccatgtatttttaggcattgaactcacaactcactcccatgaatacagatggtttgtggagaacctttcaagcactgatgggggcaggggggcagaatatgagggaaccatcaaaactacatttttccaaggacatcagagtaaatctctgggcctgagaagatgatcccaacgttaggaaacataattatttggtttctaattttacagttacatcagtttctaggaactcttcagccatctgctagaagagttatgaagcctgccttgctcattaagacctttggttctaaaccccaaatgaccttatgtatctgcagtggttctccaactggacagtgacagagatgccactgacttactgtagcctaaacattggcgagcatttcacagtgttgaaaatacccacactgaagcagaatagataagtgaagtcaaggccaaaatgtagtgagcttttgttttgtttttcccctgtgtgagaaagacccctctccatccgtgtgtttaatataaattatcagagattttgtggccctctttcagaagaggatgacatacaggcttatttcaataaaaacatcaccagttgtgacttcccttgtaacaaaggctgcgtctctcattgcagggcccatgcatttagtactctggaacacttcactgctgcctgttagatccatttggatgtgcgggagctgggttattttgcagcacagtagactccagactgctaaaaggtggtttctccaagctgtagagtgcttgttttgttgaacacaaacatggcctcattgatttaggcattcactctttagccctaaactctggtctagggctctgaaccaccagacctacaaaagctcaattcctagaaaaactttggtgtcttaactagagagatagagaggtaaagaaggagataaataaatgtgtacgaataaatgtatggccctctctatatgccatatgacctgtagatcaatatgcgacatacatgatattgcctatatctatgaatttatccatagagacctgttactcctggataaatttattagaagctctgtgaaaaaagtgcacaataatccttgcctattctcaagccttttttcccccaatgcagtgattgaatccatgtggagcctgctccattaacatagataggtttaggtatcttaggcatgagattcccatccttttgtcatcatgacaattgtctttccttgaattgttttcccttcctcattcaccttccgctacttcacaatgctttatttcattaaaaagattattatatatgaatttatataattctatgttgtgtgataattacatgataatacatattattcacagtacagtgcaaggtgtcagagaatacagaattcaattagttattcttacccttacaggactttaaaatcctcacacatttaaactgtcatctgtacttcctttccattgtttgtagaaattaattctgatctagatattctgatccagaagtattttgtaacaggccctttgtccattagtgaggaatatgtgttaaccctaaatgttctgccattttctgatgagaagagattttgaccccagaggcttcatatattttgttagtccagctgttgatgaattttaagattcaagttacattcaaacatatatatatatatgtacgtaagtttacatatataaagtatctatgagttagagaaagtgatgaaccaagaattgattctaaacaatgctgttacattttgtctattttaaatgacaatattcttatatttaacagtcaacataattcaaaaaccagactttgaaatatggtggatgatactccatttttgattctcctcagaaatgcagtttttcattatagaggttattatgtaaaggtttgatttgtataagtatataaatatttgaatacagatccaaatttatttgaactttagcaccaaagagtcaaaaggaaatgaagcacaaagtctcatgaggtaactattatttccagtttccagcgtggtgaaatattatgaaaacagttccttaaagtatgttggaccttgtaattcatccttactggtttattaatttctctaaagtagtgcctgtgtaatgaagtacttgagttaaaggtcaagtatatgtcaggaaaaaaaaaattataagagttgtctcttttaaatagtgtgatttttttttttggagaaaatactaataccagcttccaaaaatgacttattaagatgagcccagtagtagaattcttgaaaatagttaagaatctgaagatatttttaacaacttggaaataaattattaaaacagcttgaactttattctcaaactatattttaaaattttatttgaattgcttaaataggttttaaagttaataaagtgattcttaatttcagtttaaatgaatccatctttatatgccaggagatattatgggtttatatatactttaacagccaagtgatgtaagcctgacccaaattccaggagatctgctcctggtgccattttcaaacacatttgaccctgagagaacttgatcccatcttgttctggccattaaaaaggtctctgagaggtcaaatcaattctagtagccaccaaaagattctcattcttggttgattttccccccaccaccaccctgctaaagcagttgtcctctaagttcatcctggaccagaacaggttttcagaggactcaatgtagccgtgaatctgaattttgaggttttgaagtttggccacagtaaggtccataattaccagaataacaaaagagcctgacctaaactttatatatttttggtcagtttacctaaaagaaaacttaccttttcatctaaaatgtgtgagtgtgtatttgtgtgtgtgtgcattagtatgtttgtatatttgccactgtctaagacagttattttgctgataaatgttttcagtctcctagtattacgatggatagataggccagaaatttatgtcaagaaagaaacatatacataatatatgtgagagttcaggtggggatggggaacaaagaatgccactgagaaagcagaaacatgagaaagcaggcctggaggggattgcttccaaggccagactacagagttggatgcctgggtgattgaagagagctgccccagtgctggagactagatagcaccggatgttaggaacctgctaggagggcagcctcacctgaattgaaattgaaaggcagagagcctagaaagtatcctgaagtgagcagggaagagctataccttggactagagggtagagggcaatgtggcccccaggagtgaaatgaaatataatagtatataaagtctttgtctgtaagtgatggctcaggacagcctgaatggtgtaacaggattatctatgtataattcaccagcttttttctagataaaccatgagaataatggaaaatgtagttgaggaactttaaatgttggtggttgtgttatgtggacagtaagtgccctgtaaaagaacggtattgcaaaggtggaaagatggttgtttctcagttacagtctttaaagggagacagcagaaatcaaccacacagatgaccagacaacctatttggattccttttcattacccagaaagcaaattggagagagttacctccaaccattgaagaagcacctaatgtcccaccatagttctgtgctccatgagattgtttacttcccccttaatgtatttgccagtactccagaaacagacatcttaggacttgagagctttatgtgacctgcatagattcttggtcttcagtggctcctattggttgatgcttttaggttgcgcaaaagccctcaggaatacgttgggcagtgtgctcaaagtggcattccaatttttcacgtattattttcccaatggtgggagatgggactggaatccacctgcaggtctcctgtgagacagttaagattgcctcattatacctgtaggcagagagaccctccaacttggaggaggctcacctgcccactgacagtggcagtagagcaaagacttgagacaaagcaggatgtggagagactggtttccttaccttaactacccagaccagggaatatgttttcttctgccaacataaaatagtcaagcattttctgggtcccagttacggaacattagaacaactaattaggacagcccaatcaatggaaaacagattccatagaaaataaattagggaaacagcattctagatccttttttagagttcagcagtgcacgcgatcatattaaaagctctgagaagccttttgataatgaaagtggtttcactgcatctgactcactgtagctccacatccactttggaccttattttccttaaatatctattaacatttcttgaaacttagtgttaaaagaatcagaagctaggaggcagatgccgagagaggggacacggactgatagggaagggataaaaccaccaaagacatgtttagtccccagtttgagctaaaaaatttttaggtggttttatcctttgcctcatgtggcctattctttagcagctttagtaacggggttactagtgaagcctattaagactaccatgtctggaaaaggctgcgtttttttgttattaaatccttacattggctgcttagtttttgaattaagttgaagaataatgaatttggtctaattatgagcaaaccagttttttggtttttggtgtttttttttttgagacagagtcttgctctgttgccaaggctggagtgcagtggtgcgatctcagctcactgcaacctccacctcccgggttcaagcactccttctgcctcagcctcccaagtagttgggactacaggcacgtgccaccatgcccggcttatttttgtattttagaagagacagggtttcaccatatcagccaggctggtctcaacctcgtgacctcatgatccgcccacctcagcctcccaaagttgctgggattacaggcgggagccactgtgcctggccgagcaaacgacttggaacttgtgatttggaacatatctttgaagaagagcagtcttttaaactttaaaaatacgtttggtaaagatacccaggttatcaagttatttgtggcttatcagtatataatataataattatatataaatgattgctttaagaagataattctgatattttgttggtcatgttactaagcagtttttttaacagcccagtgataaactttaagcacagtttttattatgtctgaattaatgacatgtcactgaatagaaagcacaaatattttagaaaggtatccaaaacattatttactcctctaggaataaagacatttgaaaatgccgttagtgggtcttctcccacatttcctcctccccaaaaagattttttaaatttctgtgttattgattaatatggcttattttcatccacagaggccagtaagcttgtcatgtcctatgtggcagctgtttgtggaaaaggagcagaagttaatcaagttaaagaacagcttttacagtccaacccggtcctggaaggtaggatgtgttatgttcattaagtcggtgtgactcaaacagtagattgagttatgtgggtgctttgagtacctggtctgctgggaggtattctgggagggaagaggaaggaagagattcaggccaagacctgctgagcaaataagccgtgttctagaacctcttggcctaagtgtttagcagaatagtttactaatgtaaaatgggcttcctcacttaacagtcacttttccccactcaatttttatttgaattctttaaattttgattaaaaataatcaactgatcatttgcatatgatggtgcagtgctgttttattattcaggataacacctgtggctgattatttttgttgttagagaaatgagggctcaccccgagaaacacttaaggactcattttttccagagtcatagaaagcctaaacctgactggagagtgctcaaattctctatttagttctctgtcttagcttgggctgccataacaaagtacacagactaggtggcttcaacaacagaaacttattttctcaaacctctagaggctagaagttcaagatcaagctgttgtccaggtagattttattctgaggcctcttttcttggcttgtaggtggctgccatcttgctgtatgctcacttgaccttttcactgtgcttgagtggggagaggtgagagcaagctctctggaatctcttctcataagaccaccagttccatcttgagggcctcacccgtcatgaccacatctcaccttgattccttcccacaagccccacctcctaatactagctttttgagggttagggcttcaacatatgaattttgcagggagataagcattcagcccataacatcatcagaaaacaaaaccagaaatgagtttccttaatgccatggagaatggcatacaacatcagtatgaactaccttggcattggaaacagtatatcaaagtctttccctactgatggcaagctattaaactgctttatggctgggcacagtggctcacacctgtaatcccagctctttgggaggccaaggcgggtggatcacttgaggccaggagttcgagaccagccttgccaacgtgatgaaaccccttctctactaaaaatacaaaaattagctgggcgtggtggcacatgcctgtaatcccagctacttgggaggttgaaacatgagaatcgcttgagtctgggaggtggagtttgcagtgagccaaggtcacaccactgcactccagcctgggcaacagaggaagactctgtctcaaacaaacaaagaaaaaaaacttgttttatattgtaagcgacagagggagactctgtctcaaaaaaaaaaatgctttatattgtaagcatgtctttactgtcacttaacatatttgttatggtggagtaaggtttctcagcctcagcagtgttggactgcttacatgttgctgtggaagggtgtcctgtgcattgtaggatggcctgtcctgtgcatctctgacctctgttagctgccagttgcacccctgcccctagttgttacagttgaaagtatctccagacattgtcagatgtcccctagggagtcagaaccacccttgattagaatctctaggctagataggtagtttggtggaaacttttggttcaagtcatagaagtaaagtcatggaaggatgagattcaacacggattaaagcagaactgctttggggtagttttttcccagtatgaagggttaaaaccctgccctgttgtcgtttgtactcaggctcagcctctcctgccctttcagagaggctcccgaacactgagtattcactgtgaccccaagacacacttcccatgcttcagtttcaccattacaaggacacaccatgcatctgtatccccagttagtagcataagagagaaatgaaggcaaatcatctattatgctgtttttgatctttcctccattgcaatatcttaataacgaagctattatggaaagcgatatctctcaattttattgttccaatatttgactttttgtttattgtcttttgcttttaagttggggtgctatacatttgctgtatttctgcatatgtttattttaagagtgctgtgatgtaaaggagaaatgctgaggaatgctgtagcctgcatctgtgactggaatctggctctttattcagtggtatttggaactaggctccagtgcaggaaatagaagaaatgtctactgtgggcatgcattatcttttatgggaatgctttactttttagctggagctgctactgtaaatgaacatttagaacaatgaactttaaaaaaaccaattgaggaatgtgtctcaagtgttctataatggaacacttgctttttattctgtggctcacaataaaaggctttagtgtttagggttgtgtttagtaatgtgcaactcagatttgtttgatgaaaagatggtttatggcttgcaaatagcaccctgaataaagtttctttgaagcaattccttcacttgcccctgaccttcaagccacaataaactgtcctttatgcatcaacatctctagtcggacttggggctgtgcaagttagctaacttggcagccctgcatgttcacacccaccacaaaagactagcctgtgaaaacacaagaaatgtcatcgtcttcatgataactaggtcaatacacaccattatcaaggttacattcatgaaagccttttaactggtggtggacatgagataagaatgggaacctctccagcaagcatccttttttgaatatttttaggtgcaaatttcttcattctgtatagcatttcagctcatcttctgttgaagacagaatttgctgccagggacctaccaaaccatactcagcccaagcagcatctctaaggcaaagaactttgcctgtgttgactttgtaaatgttgtcttaaccaagcttgggcaactatctttttaagaatcaaaaacacagccgggcgtggtggctcacgcctgtaatcccagcactttgggaggccgaggggggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccgctgcactccagcctgggcgacagagcgagactccgtctcaaaaaaaaaaaaaaaaaaaaaagaatcaaaaacacgaaaaagccactccacacaaaatataatgcatcaagtgtggctgctgaattaccggagttaacataggtaagcacacaccctctctccttgatcagagacttctgactgctttcaaaagtcagaccagattttagcccgtagttctcatttgaacactcagtagtctaatctgctccctgtttaatttgaagaagttatggagacctctagagatttgatgcctagcctctgattccagaagtttatttctgttcaccacattattcattctagctgccgtgtggcccctggatcccagtaacagactgggcaggtgggaggcttggtagaaacggaggatctcatgcctcttcccagacccattgaacctgagtctgcactttatcctcatgtagttagtttgcacattaaagtttgaaatggtaaagatgggcggggtggggcttccagagtgtcaaacagggatcgcctctacttatacaacttatgtttaggctacttaatcttctactaccatggcccaggttaacttgctcctatcttatgcacaggcttggtgaaacaatccttttaccctatgactccgtgctgttccctgtgttaaacaagagcactgtgtgtctggaccagcgtcaaccatggggttcttaaacgctctcatttaaaagggagtcctgtgagggatttgtctccaggaaacagctaagattggaacatttgtattttgcattatgggccaaattgtttttctttgttgtctggaaagtttcacctaggtctgatgtgcataaactgatgaaaccatgtagcacttgtagcctattggaaatgactgttgtttccaaatctcttattcttcctgtattccagagctatataattaataatatttaaatagctttattttaaaattaattaaacaatttaaaggttcacatgccattccccatgatctggaaacttcaagttccataaagcctttgataataagtaatctctgaaataaccttattcagtgatgataatcctagaagagcatgaagctttgcttcctggtcactcaattgactactctctagaagtgttaaaaggtgttgaattaggtaagattaagtttacagtaatacttgaaaaaattccatgagtcataggaatgattctctttttctatgaacttgtaagacatggaagctttagcaacttactaagacttctgttaagtatatttctatggaagttttggacagaaatatcattgctacaagttgtattttccagaaatcatagatttcaaatactgtatttgctttatctttctgcttgagattattattatttttttaaccatacatctgtttctttcctactagcttttggaaatgccaaaactgtaaggaatgacaactcctctagatttgtaagtatttgtataagcataagtgttaacactaatatttagctcatgtatgtttaaacaaccagtagatgtttaatatttcttaatacacacatttttaaaataagaggaacatcatctctattgaaacacaaagttctataaggactcttgatttctggaattttccttttgaattctttttggagtaacaagcaatttttatcatgttttcttgacatcttctatcataaaatcccataagcaatttaaatgaggctatttagagtaacactttgcttatctgagtttggtatttagaaatcaagaatcagaaattaagagaaagataaactgggtctcaagtttagggttagggtgcaccgtaacccttgtcccttattcagtgggtccagaaaggatgggatgtattttaaaattaatagaggtaaagtccataggcttggcaacaaaagcaagcatgtggggtgagcgtggggctgtagagtagaactgaataataaaaaccaaatctatttggtgttttgagcttgattgagttggaaaatgctacttctccctacagggtccatctttccagcctcatcccccactactccctggcctgtgccttgcatgttgacgcagtgggctcctccaggcgggccatgctcttgggtgcctctaccctttacagagacacagctgcctggatgcagctgcaggaaatattgagtctgatggtggtgttttgaaattgatgtatacatttttataataaaagatcatttgtttaatgaaccgtcttctcacataccttactgattgccaccagggacaattttgatgatcttttatgcctccttatgtgagacccttcctgacctttctccaccttcttcttttagatcccgtttggctctttcctccttaaggttattttgtgcttaaggcaggacagtgacttcaagggagatagttttgatagtttagaaaatggcaggctaaataaggttcctaattccaaggctgtgaattttttccatcagattagccccttaagttgttataactgatttgatctgtgccttttcctgttgtggtaacatggctaatctcattacataaatagaattagaagtgaagtgtgggcgatagaagtaattctaatgaccaagcttctttatgtgatagagattttatttttgctgtttgcaaattacatacacacacagtatttaatatttgcaaatatatttagtctatagatcacaaaaatgtaaaaacccatattgcttaaaaggctattactactcagtgatatttgaaatctagtgaaaggcttggcaggtgatttggcttattaagtaacttcagagaaatcctattataacacgggtattaggatatgagattaatacctgattatgggctaaatcatttcatgcccagtttttagcagtttctctgctttgtggtctgtgacttgactagtaatatacccatgttttaattttataggaggactctactgtatttaaagttactactgtacctaacagtggtttatgtacttgtactccggggaaattgcaatgtcttcgacttgcaaaccagtctgtgttggtctggttaacctggaatgaattccttgacctcttcactgagtagtctgatagaccctgctatgttgtagttaatgcttgctcatcgtagctcacattttgaaccagtattcccatggagatgcctcacagtgtccgctccccaccacagcagctgtagtttgacatattgagctacgagttatttctgagtggactagtgacatgatcagaacccagcttttggcgagtaatcaggaagtggcttagtgggaatagtgtcattccactatcaactgaattctcagggctggccactcattggtttatccctggttgtcttccttttccattctctccagtgtttattctactctcctcaaacatcctatttttttactctcagctcatgatgttacgcctacttcacagaaatcaccatcatcatcatacaggccttcaaactgagttaatcctgcttcctggtgcctgacctatatgtatgtctatgtacactccttttacctaggctctagattctgtcgcctcctgtggccagggaccaccttctgtcaaaaggatcccctcttacatggtcaacctctgactcctttgacagagtaaccattctttccctcctttgtagctgcttcacctccttggtcccccaccttcttggaggtcctccctgtacactgagtggcctgggccacatgactggacttttttttttcctctctcatctcctgcatccaacctgggcctgttcctgtgactctccgggtagctctcaattctgtttactttttctctttgactacttctacttaaagccaccaacatttctccactaatcactgtagccacctcctgtcagctacatcttctcttgcttctttcctgttcattccatgctagccagggaaatcttgtaaataggcaggtttgatcatggcatccttgtttaggagcctttaaggacatggctttggtgtgacgagaatatctcaaagtaatcatgtgctccaacttccctctccagccttgtttcccactcatcctcacggttgccaattcttatgcctactccttcctggtctcccacctccttgcccacctgacttctgctgatactttgcaattaagatggggcagatttcctactctccctttgttcccgcttctttggcatagcaccaggacccactgtaggacatatcctcctagactggaatatccagttaacctgtctcaattcccccgctagacagtaagctccttgaaggcaggagccatgccatgctttcgcttgtgcctacttcagctttaaggaaatggttgagggacatatccttatgaataagtgcagacctaaaagggtagaggacccatgatgatgaaaaaagagaaggtgcaggagcatgcataagccgataaaaaggcacaaattgcattgttgactgagttccatgtgattgtatttcttctcccttaccctcattttgaaaattaatgagttaaagtaattcttaggacatgaaacaaaactaaagactttacttattagatcaacacacacttttccaaacaagaaacagctgtcacagttactctgttatacttgttactctttaggcaattatagaccagttcttttaacaatcagaatattaaactctatgtgtgtttctgtgtgtttaagatactatctataaagtgtaaaatgaacctgcgttatatattgctattataatctgggtgaaaagccaaaaacagtaataatgaccagtgtgattctgacctgttcataacacataatcttgtatttgatttgagtagatataaaaacagatctctgaacgtttcaattcatttactgatatgtttcaagttcctagcaatggcttaaaacatattctgccaataaaaaaagactatcttcccaaccagtctgtatacacagacaacttatttttcttctgtttttatttttgaattgagtacatatcctccagaagtttgaaaaataatcttaaatggaaaaatcacatgatggctgagaagatttgttcctaaattagcagtgggttatattagctttgaactaatggggtatttagtatgaattatttatggaggcatgttgttttgcatcgtggttatataaactgtgtctttcttagttacatttaaacaaatgtataaaaataagggcttagtctgctgttctctaagaagtacactgagttaacattttgagatgaactagaaaactcacaaaatctttctttggcagggcaaatatatggatattgaatttgactttaaaggcgatccactaggaggagtaataagtaactgtgagtatttttcttcagtccttgtaaagaagttcagaatactaaaacatatatttatagtagaatagtttagatacttgtgtctttgaggcataagaatatgtttccttgctttatatttagactttaagctttgcatttcagattgttttataatagaatgtaatttataaatctttttaaagatcacttaacatctttaccttggaaaaactttttagaagtttgctaaataaatatttgcgctactgttttttatattctataggtctttttaaaatcctataggtctttaaggcaatccagtatgaaaaaaagatcctctaagggttattttctttaacaaaatgcttatgataaaaaaaatataaataattggttttaaattataacttttgaagtaatatttattcaataaaaggagtagacctgtacttcagtcttattttgagaaatgttgcttctcttccagtgtatttaagtgattggaatgtgatacacttgttaggtaaaacagattttttaaccttctttagacatgatttgtgactgtggaagtgaaatattttatgtgaaaagttaaaaaaaaaaaacaaaaaaaacacaatcagatgaggtctgctcattctagcccaggtgcagagttttctaaagtgggtgtatgagtgccacacggggttttcagtgtctcttgtaaaaatgacagtgctgtcagtgctttggagttgtggcacccacagcacaaccctgatgtccctgctcctcttgactcgtggttgattagtttggaaaatgtaagatgatgactcagggctttgtgcacctcagccacagtctggttatcctctgagtcctctgggttttttgaggaccatagaactgaaccttctcctgcccttgcctgcctcaccatcccatggtgctattgggattgttagaatgaaaaaatttatgtttagacctaaaaaaaaaaaaaaagaaagttgactgaagtatccaaagtgtgctcatttatttttcttataacagtggcatttcgtcttcaaaggaaatgttatgctgaaccccaaagaaggtaccggggtaaaatgagacctgatctggttgaagaggagatgggtagcccagaatcccggcactctcagatgccactgagatcttcctgactagccctagcagaagaatgccatttgaaaattattatttagtaatttggtcaaactatgcagctgatttaaaaaaaaaattaaatcatgattcagagagtaaccatctagggctagaggtttctcatctttaaaatgataggattgaattggatgaattccatggttcttcccatttccagcattctgtagttcttaaataatttaacttctggctgggcgcaatggctcatgcctgtaatcccagcactttgggagactgaggcagggggatcacctgagctcatcagtttgagaccagcctggccaacatgtgaaaccccccgtctctaccaaaaatacaaaagttagccggatgtgatggcgcatgcctgtggttccagctcaggagattgacttaggaaaatcacttgagcctgggagctggaggttacagtgagccaagattgagccactgcgctccaacctgggtgacagagtgagaccccatctcaaaaataaataaataaataaataagtttccattttagtttgcccacctacacacttttgtatgccatgtgttcggattgtccatatttataagaatgtttaattattagagaaatgccttgaagagaaagttttaatatgaattgaagttgaatgggatagtgctacctaagttaaatgatttcatacacaaaatatgggagtaaaagtactcatgcaaaccacatacgatgtaaccaaaggcaagtgattataacccctgccaaacttgttaggaagactctttttacaatatatggcagctgatcagagctatccagctagtggtttgcctcagttttaagatcaccattttaaggaatgattaatatttattctgaatgatattcatgagcctttagtgctttctttttacaagacaaattaactctagctataaaattaataaaacactgtttttaaaaatgagagtaggtttactatttccattacagaacttatagctgaacattttggaatgatttaatcaatattactcgaggattttaggaaaataattcaggatgattttattattataaggattagaaaataacttcagttttaaattttgaagtttaagttctaagcacaaatgtcttcttgtcccctgattcttgcagtatccatggagaataaatattaaacactcagttcttttccaattaagattaatatatcttcatgaatggagttcatatggtgtttgttaccatttgttcccacagtgaaattatattgaaatttgtggtagtgagaacaccctggtatttaagagtatcctttgctttggagagaaaaggaatacattagtggtaagagcaggaaatttcatcctgtatagagaactgactcatcggtggtcactgggagttgctgccttctggcagaagggagtttaaagcaatggataaaccaactggtgttctctccaaactaaagaagctaaaagttagcttcttgtagcgtagaaaagaagacaaaatttgccattttgtaggaagtatattttgcctccttttccagcagctgcttagtgaaagcatagattgtcattggctaaaactcttaaccttgaaaaaggcacaatatcccttgagccaattgtgtacccaggaagtggaaaggaaagcccggtaactcctctctctttttctaaaagagacaaattaagtctgggactcacttgaaaactacatatccctgaggttagtgtcattaagagaggtattaaaatagaagatggtaaaacatttgtttcaatagagaagataaaatatagaagcacatccaaatgtttaggtgatgttaaataatatttctcctagtttgttaaggtttgttggtctgataacatttatgtttttgtatttggggattttgcatctagtgttatgaactggaagcttttggaaactagtttttaaaattaacatcacaggcatttggtggcagtttagacagtggagaacatatggtacaagtcgcaagggattctgtcttctagaagaagaatagcacagagaaatatacgctatgaagaaactattatttcagatgtgcatacacctgagcgaactatggactagacaggtcgtcttgttcacattaccttatcaagagtctagtgtaatacctgacacagcaggtgtgtaagtgcaaatacgggcaggctcttttttccttatccattatttggggcatacccgtgagcctacttttgcaactcttgttggtttatcatgtggtttccagtgtctaaacaaaagacggcaaattacttcattctctgtgcctccatttcttcactttgaaatgagaataacaataggactgattgcataggttgtcctgaggtataaattatgtattagtatctaaagcacttgtaatagtgcctggtacatagtgagcactcaataaatatttgcttttttcactatagttatttgtttattgtctctagcctttcaccaaatacatgctctataaggatagagccttagtctggttcattactgagtgaccagcaactaaaatagtgtcaaacataggctgggtgccatggctcatgcctgtaatcgcagcactttgggaggccgaggcaggcggatcacgaggtcaggagttcaagaccagcctgatcaacatggtgaaaccccgtctctcctaaaaatacaaaaattagctgggtgtggtggcacacacctgtaatcccagccactcgggaggctgaggcagtaggatcacttgaacctgggaggcagagtttgcagtgagacgagattgcaccactgcattccagcctgggtgatagagcaagactccgtcttaaataataataataataataataataataataataataataatgtcgaacaccttatatatatttgttgaatgaatgaatgatcacaaaagtaattatgtacagttaagagttttgttgagaaataaagcttctgctttattggaaaattttgtctgaatattctgtgctaatcatttaaaaatacttctaaatgaatgcttttcctaaatcccagaaagtcaaacaaaattattggtagtcagagttctcttgttcctgactttgttcagcttgaaaaaaagaaattctgctaattatgaatggaggcaaatgctgtgatttgtctatgttccagttattcttgctgcactgcctgacaaccccccgccccctacaacctcaaacttagtagcagagtacaacaagtttgggtgtttcacagtattacaactaggttctgagaggaaagtaacatcctggcaaccagtgttccaagaggttgaggaggaagcctgaagtagcctaggaaagcatatggcatgtcacttctgctgtactctatgtagtcacagtgggcaccagcttgcacagtttcaggggcagggacacagatcatacctctcgaaagagtgtcaaataattggtaatcattttattttagacagccactgtctgatagattgtttccagaaatggcacaataatttctgaccctgtgtcgacagccttgattaatcccctctctcattgattcaaagcttgactgggagatttattttgatcaatggaacaattagcaactacagcacaaccagatacttgaggattgtttatatattggagtttgtcctctcttgctgatcttgggaattcactatcaccatcatgtgaatgagcttgggttagctgctggatgaggagagacacatggaatgaactgctagacatatgagtgaggacatcttagcccagacggctgccagccagtcgccagcagacaaccaacccatgagcaagcccagcagagatgagccaagctggctcaggccagaaatatccagctggcgcccacaatcgtgagctaataaatggtattgttttaagctgctgagttttggggtgatttgttatgcagcaaaaactaactgatacaggggtgtgattgataatatatcctttccctcacccagtttggaagcacttgtaaaataggcacaagaatcaagctggagaggaagtggctttattactgttaaaggcaaggttgaggaaagtggcttttggtttatcacccaagtagatgtgttagtagtcctctggcactttggtagtgaggcagtgattgacaacgctaagcaactgctggcctctccttgtgtgcattgccccatctgtcttacagcactgaggagtagagccagatgtgtgcacagtgtggggaacccagagagctgagccctctgtgcacggccgtttccttctgcaaatctcactgctcagcaaagtattttttctcgtcctggggaggagtgagtaaggggccagcacgctgggggagttactctaaggagatgcttccacatggaaatgtaaagcaaaaggaaatggccaccctcctcacaatggagatggaggatggaacagattactctggattgctttgtttttttcacatttctttttaatttacgacacaattggcttataccttcatgtgctatctcgtggcacattgtttaatctgtgtgtgtgctgcattcatgccattttgtatggaacgtggttttactcttttaaattgtttgagatttacagctttgttcttccttttatatcatatatttgattttattgatggaaagtcatcaataaaaggcatgaaactgcctgttagaacacttcctaaaggaatctctgatcagttttctgggaatatatgtattgaggtgaaatagaagacttcctgtctatgggtcagttctcagtagtgagtggatattcgttaataaagtgtctgtttttaatctgcctttttagggtcacaaatcaaaaactaagagaatacattgcctaatttataatacatacaaggctgggcttcttttttttttttttttttttgagttttgagttttgagttttaaagctcctgaagaagacagaagtagtcaatcattggttgtgaagtatctgtagcaatacaactgaaatttcaaaagagcaatgctgtgacttcgtaatgggtggctttatatgaaagtagatgctttctctttatctcagttttactttgttgttcttcatacaaacatacgtttaccatgaaaaaagactgtatttatcatgaaaggagactatatacaaatattgaagaaaccaggtgctgaaatagatctaaattaacctcagattaatgaattaatttattcattcgttaattggtgtttattagggtagtaaatcaagataggaccagatatttcattaattttatttcaggattgggtctagaattttagattcagatacattcatgaacgaactttcaattatctgccttatgcactggcatatgcttgttgtttaatgtatccttttgctttactgaagaggcataaattcattgaaagaacctaaatgcgactgagatgcttttttcataatattagtcttggagcaactggagaggaggcacagggtctctgcgagcagtcagtttgagtgatagcctttcagtcaagctttcattgtctttctcacctcacaagacaaagctgattttttcgtaattagccttaatcaagaatttggaccacttctttttccaggagaggagagtatacataaaataatgaagcttttatcatactatctaatcctttctctgttacatcctaaagtatgtgatgtgatttttttttcttcccgaccaatacatgtctttttatttatttgtcaaaaaacttcatcctccagtaggtgcagccttagactatttctttcacaccttgtgccttggggaggctgtctctgacatgcacaggcacttatacgtgttgtggactagctgttaatgagtcgagctaggaaagcccctacataacggccaggctccgtgtcgatagtcgggtggcggcagcgcagtggggcggggggcaagttctcattcattgtttctttgtccctgcccccttaacttccccactagagtggcttaatatgtttatctcttaccttaaaatggaaatttatgctaaatttaatataaacttaaatttgtatcttgtgaggaggatgtagctgcattagaatatctggaatatctcttctgtactaaatatccagtgtctaataataactcttctttactaagtcttgttagcagaggctcaattggcggtggtagaagtacctaaggcagaagagaaggccgtgccaatgttctgctttgacttaattcaggggcacatttaagtaaattaaaatggtcaggtggtgaatccctatagtgaattgaatttatgttctctactttgagtaattatttggtatggcttcaagctgttagattatgttggtgcatgcacatttaggggaagaaaaccaataaggaatggtcttaagcatgagtaaatttgggggcaaacattttccctgattacttttctacctggaagcttgtgacttatgagaaaagtcataaagaaattgaaatgggaggctctagggtaatagagtaagcattttaagtggtaaaaccttcaactgctttgtaatgaaagattccttatcttgtgtgattgagttgcttaggcgaattcatgtatttatacaaagtacagcatttccaagtgtttaaggacattgctttttttttggctggaaaattataaagactgtaagcatgatacctagtcacccagagctttgaattctggctctattgcttaccaagactgggatgcgagcctcattttctcatttgtaaaatagggattataaaaccaacctcagggaaggtgttcagggttgaatatgataaaaaatgaaaagcactgaacgcatagcaaaaggtcagggaaggttctctttctattttccctttgcacctttccttttaaactcacctagtatcatgtttcacattggaatatgagagtaatcactgatcatatcagtgtgtgcagtttacgaagtacactttgccagcattccttttcatatcgtgcgcaagtgaatattattcttgaacttggtggttgttatctgctgaatcttacagtcattgccatttctacactctgcaatgtctatgagcgtttattcaaaaggtgccaaacattagactggccagtgtgttgctgttgcacagtgtagtgttgtcacgggctttttgatggtgttattttgtgtcttgacctactacagtttgcttttgtaatgtgattgtggaagtgctgccaaacaatcgcttgtcatcattataaggtgccactgtaaggtgagaggacagcagctcacctcgtcctcactcacaagggccttggcatctcactgtgaagagagctgctgctgtttgtttgggtggcaagagcagccaagaacatgtgtgacttttgtagaccaagtggaaggtcatcacgtgtccagctggtgctaaacttcttcccaaatcgctggcacatagtgcgttagcagtagatgacctgtttgaaggaattcgtgcatgaatggatgaagtcaaatgtagcatttgtttatattttttatgtaatcaagccactttcttctaaacttgaggaatttcctataaaaattagcttttcaatgaagaatctgcccatgccctgtgggttttttcttctaaaactgttacaggatcccatagaagctcagtcacatgataagtaaaatcgtactgcatgtttaacattacttatttagtctatcttgtgctttgcatgtcagtttttacttattaattgactgaaacattccattttttagagatggtaactattacacaatccttttttccctaagttatatcccacttgtacttttcaacctttggggttttttttttttttcatgttttctaaatatgaagccttcattattttccatctatgatttgaggacattggcagtcttccaagtcatatgagagctggagaacatgaaaaatctgcagcatcctgcgcctaataatttttgtacttacatatttttgttctttttcagttggctcaattttatgttttcttatgctgcatctctttattcttacaatcttatgtatttggagcacgctaggacttctcattcatcaaatatatatcctttcactctacctaaactcctccacaaatgctggtgtaggttccagaaatacaaattaaaaagtttaatgatcgttcctagattaaatggcacatcattctctcccttaccaagcattatcgtgatgttttagattgcagcctgattagggggacgtgaaatttgtgtgttctctagaattagtgctcaataatgacattactaatttggaattttatagttgaagtttgcctttgcccacagccttttgtatcactattgagtgataagcagggctccagacaagaatatcctcgtcatccctcccttccttcctcctttcccatttgaaaatttgggaagacctcagatttatgggttgaaaaattatctggagtcaatgaaaatataatatcaaataacaccaaattccattcaatgagaaccatctttctctaagacttcaagatatccacaaactctacgttgcttctcccaggtagtggggcatgtgggtgcaagagtcctaatttcaaatcctagttccacaagctgccaactgagttatgtaaactcctggactatcagtgttttcaactgtagaatgataccttataaaagggttgggaggattcagtgagataccatctgtaaaacactaagcacataataagatctcaaagtattaactaatttttattaaaattactaggtagactcataattgaatggctgtatttcattgcttacatttgtaacgtcacattttcaggaatttaatgtcatcataaaaaaccaagagcatttattagtataaaaatgatatttaatcagtgttttgaatgtaacttatttatatattcattatttaaaaagaacgtgacctgtgtaatttggtgattttcattagagttgtggttcttcctgaagctagaactgaaaatacagcttcctttattatttcattttattactgcagaatagaaagaaaaaagaaagtgagaaggaaaaaaagcatggtggatttggaagtgaaacaaatgccatactatgatttaactcttctctttagatcttttagagaaatctcgggttgttaaacagccaagaggtgaaagaaacttccatgtgttctatcagctgctctctggtgcctctgaagagctcctcagtaagtctctgtttctatgtggtgttgttgttgttgttgttgttgttgttgttgttgttggagctgggagtctcactgtgttgcccaggccggtctctaattcctgagctcaagcgattctcctgccttggcttcccagagtgctaggattacaggcatgagcactgtgcctgaattgtttctatgttttaattttcagtgtcacagcactttttgaagcattctctttaaaacatactccatatgctttgccccttccttcttaagaatattttttatgattctagttgaagtgaagaacatggtgtatttgcttctaccacaccccagggtttgtgtaatattcttgtacctcaccagatactgtgccatacgtctccgatgtgttgaggactgtgcagatgattcagtcaactcaagtggaatttcagcagctagaactgcctcagtctggacttggccaaagctgattattaggggagggactaatcatacatttaaaaaataaaatggaagaatatgatttttctgtttggggagagaaaattatcagggttctaattaaatgagtacaattctataaaaacaaattgctaggtgaatatttaagaatagtggggaagacattttgcagttgatacaagagataaagatctgatatttgggattttagagaattaacataattccacaaagatactatctaatagctaatagctaatgatgaaaagtagtgaacaaatagttcaaagaagaagagctatgaaaagtcaacaccacttaggaaaagtcatcttcactaataatcaacaaatgcagattaaaacagccctgaagtatctactatattattatatatgtagatatataatatatacatatactacatatagtataatatatgtagaagtatctacatatattagcaaaagttattaaggatcaagctagcagagttgtcactgatctgcttggagcttgtggtatacccatctgtgtagagctgcgggtgttacttcaaagcgaggacctcttataatcagagcatgccatccagtcacaccactttttggactatattccaacaaaataattcagatatgaatccaaaaaccaattggtatgaagacatttatcactgctctatatttattattataaactagagaaaacccaaatatccaatggtgagggaatcaccaggcagaacacatatgttataatgaaataatatattgaatcaccaggcagacctcatatgttataatgaaataatacattgaaggtattttttattataaaaactctggaaagagacttacctagataagtataaaacagagtttgtgctatcacagtgattaaagtcattttaagaataatgctgttactgatatttgggtataatttgtgttcttttgattcaatacttaatataaaagccatgttaccgatgtgaacaagatatcaaagggaatgagatattaaagattggatttattgaagcaacttaacaacttgtgtctttgattcaatagataaacttaagcttgagagggatttcagcaggtataactacctgagtctggattcggccaaagtgaatggagtggatgatgcagcaaattttagaaccgtgcgggtaagatgtagtactttcatcaagctttaaattgcataccactgcattgctcagcgggagctggtagcaattctgagttttctttaaagtgtagctcattctccctaaggttttagaattatacaagaattctatttttgttactttgatttttttactagctcaaaaatcacacaagattgtgaaggccatgcttttattagagcatgtgattttaccatttatcataaggagctttcttattctattatcctggggtttgactcctttaaggttatttttaaattccaagtgtttttatggcaaaagttaatttccaactgcccttggatcatgttaaatcaaaactatttttgagacagaaaaaaatctttttatatagtttcagaaactcatatataaacccgagcgattagcattccacattcattagaaaagatgattttaaataacactatactctgttttctgtcttaatgtgtgatacacttgacatgatatggtaactgggatttacttgcaagtgagacagctgtggtgatggggaaaggggagagtaggatgaattatagataaaacaaaattggcatctgttaattgttgagggtgagtgaaaggacatgcgggttctttccctgctctctctacttttgtatatgtttgacaacaataacaaaaacttacattactcccattgctgtgtagcctagtcatttttaaaaagccagctgttctcaaaaagaaagtatctcttacagtatgtcgttttaaaaaactgtataaacatcttcatatggaagcaatagtctgttgatccctggacatgattttgtttaaaccttgagtccaagactggttttagaaccactttgcctggcacgtaattggcactccgtaaaaatttatgaatgaacagatgcctcctgttacccagtatcttgggctgggctcttcacctttgcaaaccacagtttttctgatatgtaaaatgaatgaggagcttttctttgtatggagttgtgcaagttggttttgtttctagtagcaaaacctcagtgtaaaaaaaacgacatacatacaaactgagctgctgtggttgaagtggaagtagggacccaaggctctgctcccagcctcctgtttcttctgtcttcctctttatgtgccctgcaacccccgccacagcaccagaggtacccccagggttcctcgaatcacagttggaaaccactgaagatatagctttgtcttttatgggtttttttccccagaaataaatctgtaatatgattcattaaaaaagaaaagaaaataactataagaaaaaaatagttgcttttttttttctctccccagaatgccatgcagattgtgggctttatggatcatgaagctgagtctgtcttggcggtggtggcagcagtgttgaaactggggaacattgagttcaagcccgaatctcgagtgaatggtctagatgaaagcaaaatcaaagataaaaatggtacatccgtggagaatcaactttgtttgtttaggaaacttgctttgaacttctccccactttttaatgtagaaagtaaaatttttgctttgcattggtttgagaaagctttctaatgaaactgagcagaaatagaactgtggctaagctttgttttttgatgtatacattttatactgatctgtttgattatgatttagaaagaacatcctaagccttcaaaattattattagcagcacgtgtacagtcactttttgtgtccatcccctgccttcccacagagttaaaagaaatttgtgaattgaccggcattgatcaatcagttctagaacgagcattcagtttccgaacagttgaggccaaacaggagaaagtttcaactacactgaatgtggctcaggtgggtgaaacataatgtacagacgaaagtttcttaaaagtctgtgctaattttcatataagtataaacaaagattttagtttacaggctgttacctgaatcgtactatgttctaggcattgggaacagagcagtaaactaaacagataaggatccctgccctcatggagcttaaaattctggtagagggaattagatgataatcagtagacataagaaacaagtgctgtagcaaactagcccgtggtgtatgatcagtgaactgagagcaacagtagagcagagtaggggagctccctggggcagggaaggagactcaagtgaggtgggaaatgactgaagggttttgagcagaacagtggcatgactgccttgtatttcaaagggtcactctggctgtgatgtggagagcagagggtcagggaaaaaggagtgaaagcgagggaccttcgaggagatgtgcactaacccagagatgatggtggcttgaaccaggtagtcgcagtggagtcagtgagaagtggtcacattgtggatattattagagggtagaggctacaggacttgctggtgctagctggtttaagaggaagagaacaatcaagggtgatttaatgtttttggcccaagcaactggaaacatggagttgtcatttactgatttggagaagacagtgggagaagccaaattggcctccctgccttacttcttgaaccccctctacccttgatattggggccagtgaagtctttagtctttgtaagacacaaatctgagctgctgccttctctccttttgcttcaagttaagtgggtgggtgtttggatggttgcatgcctgtatacgtgcatgtatacccaggcagcttctgcagcccctttcactaaaaccctttgtgctatggcttacgcattttaccaccagtcaatgactcaggctagaattaaattactaacttaggacttccactcaggcccccactttgtccaactgtattcttgttgtctcatcctcataactatccataaagcctccataaatggtagggtggagccaggcttgccctctgttgctgaaccagcctttcctactataatccaagaatgcctttatgtctttagctttcaacattgatatcttattttaggtgagttattttggctgtggcaaataccataactttatatatatggaaatttggtttgtagcaatcgtttcctagctatagccattgcctgtccttcctcctaaattactgcttttgctgtcatatctgtccaagtcatcctcactaattcacagtcagatacgaagtaacttacttaatcaaggaaatgctgctgagagcctgtacagcacaagcccacacataggccctgagttgggaagtaagaggttagggaagaccccatggaaacaatcaaaggatttagatgtgtgaagtatggctgaaagggcatatcaaaaagaaaacattgagaaaagccagatttggggcacatatcagaagaaggattaatcaagcttggctatagctgtagatatgtaaagaggattcagagcaatatggctggaaaggtgaagtctgcagtcagagtggcaaatctgcaccagtagttcttaaacttgaacgtgcatcaaaatcacctggtggactgactgactaaacatggtttgcagacctcacccccagtgtttgattcagtgggtctggggtaggaccgaggaatttgcatttctaataaattcaaaggtgacactgctgctgctgctgctggtccaggatcacattttgagagccaccgagtttggacattttcaatagccagagtgggaattgttaagtctgtaaggaagccatgaaaaagcctgtgttgtttaagaagaccctttaggaatatgtatattttgggtctttttaaaattgtgtgttttactcttgcttttttaatcatcctgtatgggaaccaggcccaggtgcctctgactttataagcttattttagtcaccttacatcactaaagaaaactttccacattttcttaacctttggcataaaagaatttggctagagatcctcagctattcggctccttagtcaactgtttttttttttatttttaatgtagtactcagagtatctggttctactgatctattgcctgggaggttttgattgctgtgagaagtgatttgttttattagcctttccacatagcttcaattcctgggccccagcatcatctttattgccccatgcctccttttcccaaggcatttagacctttctctagataggaggactaatactgaaataatagaaactcaagacaagagtttttcagcttctccgacatactctctccttggcttctgatgtcctctgaaatctgatcccacacagcttacctcagtttattccttgctagttctctgttacctgctgcctctgctccgacctgcctatcaccccccatgtcatgctcattctttctgcccatctaaatgctctacctgattgtgccctatcctaggagacttctttgatcaaataggcctcctgagacaccccgcacccccatcagaacctgttttttttgcagtttggcacctgtcctctgcttgtttcctctgtgttagtttgatctccttagctccactctaagctcctggagggcaggccccatgtctgtgcatctctgagtctccaccttgctttgtcacttgccgtcctagaccatgcctgttactggccatgtctgcagcacattccacctgggcttttcctctctgagtttcatgcagctgcagaagtgcatggtcttttcatagtgtgctttgaaactgagatggtgaattagtgcactttgagtcttccctcgtttctacaccccatattagtggtccttaagtgggaatagacattccttcccttactgctttataggataatgttgtggagatttggtggcatgaatcaggctcaggaagtcaggggtggcacattggcagccaggtggcaaattggcagctcctagggccaggtaaagctcaatatttttagttgactaaagggtagtattttctttggttttgtttgtttgctctttaagttttgaatttgagtgcctttagcctggaatgcatcctctaaccccaatagagagagccatcatttcctgttcatttctatcacacagtccctggaaacatttgagtttgagacccctggaataaatattgttgaagaaaccaaagaagattaatattggctgtgaatacactttaaaaaatataaagcaatttatcagaataaattgtcactattagttcagttgtttattgaaatagtggcttgttgaaagtagatagcatgtaactaaaaaagctggacgacattaagatgaaaaagggctcatttacaaaaacatggtgttttgaaattatgtggtgttttgagataacttgaatttataagaagaaaaaggaaaggatttggaaattatatagcctcatgaggtagtagtagacgaaaaggatacttcagaaatcaatataagtacatctatagactaactgtgtgctaggcattattctaagcacttaaattacctattttaagaaagcaaaaactagaagaaagggtattggggaaagatgcatctaaattatattttgatttctctgttttagcatttgacatgcattttctactatggaagcattccctcccttgtttgtttatttgtttgttgccaactcttaggtatattctctaaccctaattggagtagggagggaggtttgggattagcatggaaatgtcagatgaagggaaaaggtgttatcttcagctgtgttatgttgccagggaagtgaatctgttattaaagttgttacattttatttaggaagaaatgtagagaaagtattcccacataatctaacaagttgtgctctttgtaaaataaaaatgtactggttaattttaacagtaataccccaatttttacttagaagcagcaaaatacacacatacggccagcatgttgaaaatagcaacaaaacctcaagctttttctctcccaaggccagttccttgttaggctgctgacacccaacctccaggcctccccaggatgctggtattaaacatctcattagtacttacttactgtatgctctgggcactcggtgcatttaagggtgtttagattcttctgtccaaacctgactttcttcggcctttggattctaagagtcatagagatgcatatgtcttctgcctctttgtcaagtagttctgaataactttaaaagtagataagcacgtaagaaggggtttatgttcattctataacttaaaagaactcattgtggaagtttttttaaatactcaagtgattagtgtggccaggcatggtggctcatgcctctctaatcccagcactttgggaggctgaggtgggtggatcacctgaggccaggagtttgagaccagtctggctaacaaggcaaaaccctgtctgtacaaaaaatacaaaaattagccacgcgtggtggcacacacgtgtagtcccagtcactcgggaggctgaggcacgaaaatcccttgaacccaagaggcagaggttgcagtgagctgagattgtgctactgcactccagcctgggcaacagagtgagattctgtctccaaaaaaatttaaaaataaaaaaagattgagtgaagaaaaaaaatttgcagattccatcagtcaaagccattttcatatatctcctttgaatttccatttctgtgtataagggttttaaaaaatagttatcatattaagtagacagttgtttaattttcacattacgcgagcatttccatttcattacctgattttcataaccatcactctctgatgactatgtaacattactctcagtgcatgtttctcttactaccccctattgttggatgtctaaattgcgtctgatttttctctgttccataaaattgaaataaatatctttgtggtgaaagtttttgcagtatttaaaattagtttcctggtttgtgaaaaagtgtaactgtgtataaacaatttgcctaattctcttaaaggtttgattgtttatgatacaagaaaactggttctgcaaagatgtgaaataaaagagcttcaaatattttttaaaagtatctttatgattttattaaaagtaagcattgtggaattgtgggtgttaagttttgtttgtttgttttttaataggcttattatgcccgtgatgctctggctaaaaacctctacagcaggttgttttcatggttggtaaatcgaatcaatgaaagcattaaggtactgaatttctatgagcaaaatcagttgtaataaatggtattcacagtataaacattaagttgaagaaagtttaaatttataatcaaataattgattgccacttacaaagattattccttaaaaagagtgtaccatgtataagattgaaatttgtcagggattttgtttattttgttttgccatgtgtgttgcttctgactggtgaatagtctgatggtctttgtggagttactctgggagtcggcgtcccaggttttggcctggctcacctggtaactagtggtacacactttgctgaaaaggtcactttacttcactaggtcatgatctaatcattactaaaatgagagtgttggactaggtgattttgaaaggcaccactaatgccttctttaaatatatcacctattattaaaatttctaaaagagttctataccaatgcctcatctcatacattttttaaaaaacaactaaattagttattttcttacttaagaaacataattaatttgtaatatatatctatgttccttggatgcttgtagtgttatatttcatgccttaattaaccctttaatttgaaactttttaaaggcacaaacaaaagtgagaaagaaggtcatgggtgttctggacatttatggctttgagattttcgaggtaagatttaaaattttttttgtattgtctttagtagagtggaatggttggaaattaaatcctgtattatgtagacattataagtaactgtaactttgaatctacaaataatccttgtgtagatgtaacacactatcactttgaatctgccaacaaatctttgtgtagatgtaacaaaatttggttgtgtattcctgcatgtgtgcctgagtgtgtgtgtgtgtgtgtgtgtgtggtgtgcgtatgctgagagccagcattttggagacagtactgcttaaaaagaactcgtattagtacctgacttttgaaattgcgtatttaaatttctaaccgtgaggcttccaacaagctacaatgagtatgtctgtggccatttgtgtgttgttagaaagtgtggcaggttggtgccataaagaaagccacaggagggctggacataggttctggccttgccagggctggtcatttcatctgtgagactcagagaaagaggatttggattaggtgatgtgttgagtctcattactgtgatcttatgataatgaattctgctgcagaggttgaaataatttctgctgaagctcatggtgaattttttaaaatgattctatgcttgttacagattaaatatttaaaccatttgtgcttggttaagcaacacatatacctaaaattagaatgatatagagaagatgagcatggcccctgaaaaaagtgatttggaaaataaacattatctacttatgttagaatttcctttttgcccccttgctaactttgacatttagaaggagttttaaggatctattaaaacatttattctcacttttaggagtggtattttagtttggttcacggaaataagaagtagatcgggctcctcctttcttaattctcctccacaagtaagatttgtgaatttctttaaggaaccaggctctgcccagaatgttcccaaagaatttacatgttctaaaaaattagggtcacagaatctcagaaaaaaaacatcagatcattcctttcacctaaaccagaccttgctagcacatgcctttttcttagtatgttttccctcaatcatattctatatttaatagctaatggtaagtactaattgagggccgactgtatgtaagcactgtggtaagtggtgtgtgtatggtctgatttacttttcaaaacagcctcatgaagtagctgttattattatgaattccattttacagatgagaaagtaaagctcctcaggtcaactaactccccagggttatacagctacttagcggcagactcaggacctaaactccaggcccttttaatattttcatttattgcttttctttcttactaagattgagaccaggggcacttcctcacctttcttcccaaagtaacaggttccccagtatctggaagtaagaaaaaaataaatgtggtaagtctctgactcccctgtttctccacccttgtcattactccaagctcctggccagcattgggtgcttcgtagatggaagtgtgtgtgctggtggcttccccatggggtccccagaacagaggtcttcaacacagcatctgcttgtattgctgcccatttagcagaatctacaaaggaaagctaccaatttcttggtagaaagggaagaatttgaggtttctgagttaggagaaatgcttgagtacacacagaaatcactgccgaaattaatttctttctagcaagacctcaagttactatcactaaatgggcagaatgccaaagtcattctttacagttggcagggaaaaagacttactacctagcacattgctgtgctaatctagatttaaatggtttcatgagcaggggagatgggtaagcagagatttcactagaaagttagattaagaagatacattcaatgacatttccaaagtcaaagaaactgattttgttttaattttgctagaaaaggattattgatcttaagccagtgggcaatggcttaatatcatatcacaacacatggaaagtttaaaaaataggataatgaggttatgatgggatatctagttaactttgacttccagtaggtcctaagatctaattagccatgggaaaagaaacacttataacactcaaaggaaactgagttataactcataaacaattcgagtcatttctcaagtgtttattgagttaccagataccagtagtaaacataactgagatattccttgtctgcatggagcttagagtcttagccctaagattgagagtctgtggctgccagaggatgtatcctatcaggtaggaaagtctaatcaggaaactatattacgttttaaaagtttgtttgctacagacctaatcagaacagaagtcagatgttcctgtgtaaacatcctttaacttgatgctgggtgaaataccctatacccttcagcaatccaagaatatttttcacttctggttaattcaagtttctctccatacctgtcttgctgaatgtgccctccttctgcaagttataccatcatttttctcaacactgtttcaactagagacttcagtttatgaaaatgcctgcgttatatttccttttttttttttttttttttttttttgtgacggagtctcactgtgtctccaggctggagtgcagtggtgcgatctcggctcactacaacctctgcctccagggttcaagtgattttcctgcagcaccacgcccagctaatttttgtatttttagtagagacagggtttcaccatgttggccaggatggtctcgatcttttgacttcatgatccacccacctcagcctcccaaagtgcagggattacaggcatgagccaccgcgccggcctggctgcctgtgttacatttctaaatattcttcctttcttcagaggattactctatttcagtggttctcaaatggctgtgcattggcatcacctggggagcttttgcaaattcagatgtctaggctgtacccagagcaattatgtcagaatctctggagatggggctgcagcagcaacctttttaaagctctgaggtgattccagtgtgcactcaaggttgagaccaaatgctctgttagacagtagtctctggagtaaactgcagattccaaacatgtggtgttcatgctgcttggccactgtatgaaacacccttgtaaaacattgggcctcacctactgttcatctgggcatggtggctcacacttgttatcccagcactttgggaggccaacgtgcgtggatcacgaggtcaggagatcgagatcatcctggcaaacatggtgaaaccctgtctctactaaaaaatacaaaaattagctgggcgtggtagcttgcgcctgtagtcccagctacttgggaggctgaggcaggaaaatcgcttgaacctgggaggcggtttttactccgtttaaacagaactttcagccaaggccaaatccaatcagttatatgtctatagcaaatcttataatggccatcaaattataaaaatttaactttccttctacatgcagtaaataatttttctttttttccccccagttccttgagagaatcaagatttgttttttcattatatttaattgttacctccattttcctttttaagccttctcagattaatcttcagttttgatttttaataacttttttaaataaatttatttgtggggaggttagattagcgatttggttggggatttttaggtacttttacctgctttttaatacagagttacagacgtgtttttcttcttttaataaattattcacatacattcccagatgccagcctatattttcctggattctcagcaatgttagaacacatggagacatcaggaagctcagagtgttaggaaaccaagaaaattaagaactttaaagtactgcaagttgaagtacaaggggtcagagtatggaagaagtattcagatccacatcaaggcaaaaatgaaaatttctgtgatattttccacccaagtgaaaagaaactgctggagtatagataacatgtatttttttatttgttctgttgttcttcaattgactgtaggaattaagagttctgccttttagaataccctgggcatctctttaaaaactggacactaaagggcgagacttttttaaaaaaatgcgtctagttgtcccatggccctgcagttcccatgaaaatgccttttttagctgagctggtggaaacctttcattccctgtggtctgtctctgaacggaagagggaaactgatgcattaaaccatgggttgatgacacatggatttgactgcaaaacatcccagtaccagctggaagtgctgcctggctggccacatgtgatccgatgtcagtttggaaaatagatcagtagaacattgataccaaaaataaggtgaagtgaattaaaatgcatagaggaaaaaaaatctagctgtacatcctggtagaacagaagaccaacttcccaaaggaagaaaattgtaatgcaaatactctgattccacacatttatgtttggacattcttataactgaaaagatggtctgtgatttctgagaaatatttatagcatatccataaaagaactgctattctttttttgaaaaaagatattaagttaaaaagtaagttgaacaatctacattgatttcagctcgttttctacatacttatctgacaggcattaaaactggcagatattttactgggaaaatctgattggtcattagtgttctgtagaccaaagcaggcagtagtagctgattatttcacctttcatacagtggagctagtttaacacaggcaaagtgctaattactttcagttatggactccttatttatcttgccctcataaacctcactgaaagtgacccatatatggtaagagtatgataggctggatgcaatgattatttcaaataaaaaaatctaatacttgggcaagagtcattgtagtctggtaggtacacctcatgatcataggatttgttttctaaattgtttttaaaagaaattctggctatagtcagcaccttctactctagtttcttgccttcatttggtccttcttatgctagaaagcttataattgaagaggaaggaaacaatttaaagtagatttaaaaacaaaagatgacaactgctatgatttgtaaaagatagatagatagatagatagatagatagatagatagatagatggatccaactgtgtgaatagccagcaattcctgaatcccagagccgggcactcctccccatgtgtcagtctcatgaatcaaagtcttatagtgtatattttatggatatgctgtaaatatttctcagaaatcacagaccatcttttcagttataagaatgtccaaacttggcacggtggctcactcctataatcccagcactttgggaggccaaggcgggcagatcacaaggtcaggagttcaagaccagcctgaccaacatggtgaaaccccgtctctactaaaaatacaaaaattatccaggcatagtggcatgctcctgtagtcccagctacttgggaggctgaggcaggagaatcacttgaacccgggagacggaggttgcagtgagccgagattacaccactgcactccagcctgggcaacagagcgagactccgtatcaaaaaaaaaaaaaaaattcaaacttaaatgtgtggaataattggaatatttggattataattttcttcctttgtgaagttgggcttctgttctgtgtaataatatgtgtgtatttcttccaggtataaaaagtttttagatgaaagcctattttaaaatgtttaagaagagcacgataacattgtttttcttaaaatttgctgtattttagtatatacctggaagaaaaaatgttaagggaaattttctaaacctttagctagtcattcaattttgtaaatgtctaaaaaggagactatttcatattaaatggttttctcatatattttgaggattttttaagtttacattctaaaaaaagcaattcttgttttggagcctgtttcttgatgctgtgatatttaaaaatggaccgtggttaagtgcattatatttttctataggaacagcattataatcagaagctgtcaaaggctttaacaccaaataaatctttgcaaggaccaacagcatattttacagcaataatatagcccaacttccctaaaatagtgatatacactcaaaatcctgtaacttttatataaatgcattgactcatttattatgcaggagactttactgtatgtaaaaatgtagaaacccccaagccagcatgttatattcaaaatttgacctcaaatcaaagtgctgaactataagaaacactaatatgtaattaacataagccatggtctttgtgtttggactgctcgctgtttcaaatacattatattcacctacagactccttcccatttctctgtcccaaatacagagggacagagctgccacttctatttactgtcttcctttcaatatttattgtttttaaagagcctaagagtttttaaaatacctgtcttccttaaagagtataaaatatcatcagtctcctttgttgctaaggagaatatacaaaggggccagtatttttgatacatcttaatttatattggagagtttatgattgatacttgtgagtataaagtagttatgaatcgactgggaataagattttctgggctttgtttttttgttgttgtttgtttgttttgatgttgaaaggatggactcaaagtctagaattcttaaaagaagccctagcgtttaaaatttgattatattatatacttctaaacatagtaagtgctccctatcccaatctatagttggtaactatagtgtgaaatagcagagaacagacaccttgctgtttgcctttgttctctaaagcagcctcagcttcatttagggaggttatgtaatagaaagcccagaaggtacttgtttgaagatgtttctaagttttagttttattccttagtcttcagggataaatgtgggtaagacagtagagaaaaattgcatacttggagcatgggtggaaaactggagagaggagatgagtcattcctggggcaagttcctgcccacttcctcttctggagactttgattcatgagcctgacacgtgggagagggcctggctcagggattgctggctattcacacagttcttgacaaaccaaaaaagtctccacatataaagttgctttggggccttcctattcatctggtggtttctagtctcagtttagctattttatgaaggagagggggcccaagttgaaaaccaggtattaatttaatatttgtattaatggaaaaatgtgttagacctatacaagttagagttctgtgaactgctgccaggctattccttaattttctgcagattattgattattccttaaatttttgaaagtttttaatcatatgtgcagtcccattttcctccaaatttgaacaatgccatcaacttcagcttagatcacaagagaggtgtgtgtctttagccttcactttgagcagtaaggatcatctaggtgacccatgacatgttttggagactttggaggtgagtttgcaatagatgctgatttctgtggggaagtaagttaatttctacatcggtgattgtgctattctatttttgttttggtttttttttggcggggagggggcggtgtttttttagcagtagagtaagttcagacagtcaagtttttgttattagggcatctccaggagaatactctctccttattggtttttgaaaaggagccttagcacggtactacacagggatgtgtccctggggtgggaaaggggagttacttttggattatgatggatctcttcactttttggtgatctgccaaccaccactgccctgactgtttgggtggatgtggaccttggatacatgtcatgcatgttttctttttttcttttttctttttctttgagcaacatggctgtttatttcacctgggtacaggcaggctgagtctgaaaagagagtcagcaaagggtggtgggattatcattagttcttataggttttgggataggtggtggagttaagagcaatgttttgggggcagggggcagatctcacaaagaaccttcttaagggtgggggagataacaaagtacattgatcagttaggttggggcagaaataaatcacaatggtggaatgtcatcagttaaggctattttcactttttttgtggatcttcagttgcttcaggccatctggatatatacgtgctggtcactggggatacgatggcttagcttgggctcagaggcttgacattcctgtcttcttatattgataagaaaaataaaatagtggtaaagcgttgggacggcgaaaattttggggggtggtatggagagagaatgagcaatgtttttcagggctgcttcaagcgggattggggcagtgtgggaacctacagtgggagagattcaactgaagaaagattttgggataaggggtgatattgtggggttgttagaaggagcatttgtcatatagaattactggtgatagcctggatggcatgttttctttttcctgataatttataattagaagcattggattttgaagctttaaagcttcaggcaagttatatgatgtatcattatttcagtcaaactgtttttatcctgaagaaccctcccctagcaaaccacagttcagacaccacaggaaggtattgtggtcctgtcttttgaattgactggatatgggtcttgatccaaagttttacactgatcaaaaatacagcctgaatggtaaaagccatcatttgtaaccatgaataactatcaatacatgctcacttttagaagtttattgctaattaagaactgactgcattttgtgtaatttgtccctttttgcaccagaatgcagtaagtatgacctgtttgcagtgctggtctgttgcatgctcttgtgttaatagcttctctagctgtgtgagttttgcagtaagtggttgttgaataaccatgtggatataaaatacagaatccatacaggaatttttaaaggttatgggcaaatttaatttagttgtaacttaatccttaaattgttttgtaattgtgaagctttgcctctggtttctaatctgcttgtgtgtatttcatggtcctgttttagaagtgtactttgagctgttcatagctacacaatgtgtctgaggacactagtgctttcctttccttctcattatttgctgtttgatgatttagcataatagggttgaaatagctccatgggcacagacttgccagataacacatttgttccatgagactgttgtctaaaaaaaaagtcaaagatctgctcttataagttattaatgttttacttttacttataggttttatttatagttgcatcatatagggacatactttagcaaagcaattgagactttctgatatatggaatgcctttatgctgagtataataataataaggcatctatactagaccaacttcagtttctaattgaaattgttagctctgcgaatttgagcacagggttttaaaaaatttgtgtgaaaatgaggactgaggagtgccctttgtatctgactatatttgtcaaaattattgaaaataaatgtttgccttttagtaagactcttcaagacataaaacaaacaaacttttatccttaactaagtttagcattaacaagataagtcactgacaatatattcacatgtgttatttatgagtttgagtttaaaatttcctctgatcactgcatcactggtgattagaaattcctagctgacttccaggaaagaatgtagttagatgctgcagcataagtatcatttttaagttttcctaagtaagaccaaagttgatttttaaagatcaactttcagaagactctgtgactttttcacttctatcatgtatggagggatttgaaggccagtggctctgcctgttcacaaggagcagtgagctttggctgcaccattacatgtgggctctccttcctcattagaccaggactggccaccattgtgggagaagagtccagtttaccagtggtggagtcatactatccctcgctcccactgccaccatctttgggcgataaagaaaaatagaggtgaaaacaagttttagtgtcagatctacttcttcctggacgatgtggttcttgataaatttattcatttggtgctctcaggatgtacagcaatacattaagccctgcagattgttcagaaatgatttaggcataaagcttctgtcaacaaattcataagagattaatatgaaggagaggctgctgagacttctaagagtgatcaagggtatgggccttctacagagagagagattgtttcttgtcagggagatgctttaatctttgggtctccatttggtaggaacttcatttgttcatacagtcagccaatacatattgagaacttgctaggtgtgaggtgctgtgtaaggggtaggaatacagtgaacaagagagcatggtcagccctcacccataagaatgtacagtctagtgaggcagatgtatatgaaactaatctgtacatgtgtatacttacacatacacacatgttcgtataacatgatttacaaaaagggttaggatgcaagagtcagagtgagggatctgtccctggatggggacaataaggggtcagttcagggggacttccttgagctctgaagtttcacctgagaatgggagattcagaacttggtgacagagattgtggagctcactgtgtctttgctgatccttcagcaaaggaagtgagattgtttctagcttttctgtttggggtgcttctctgtcaactaaaagtcttcatccttcaaatattgcatcatttgtgtatacttcattcattcacttactcatgacccactcctcgagtgcctgcaatgggcaagcgtctgtcctaggagccgtgtgctgggccacagttaaatctgagagatcatgtgtggcatttctcatggattgagatgtctgagtgtcattgttttgagagagctagtggcatggtttataaagctgtttttcattttctccatacaggacaacagctttgagcagttcattattaattattgtaacgaaaagctgcaacaaatcttcattgaacttactcttaaagaagagcaggaggagtatatacgggaggtaatgttgaaatgctatttttaaaagtgttggtccttttttactcgtaatataaattctaattcagaagatagcctaaacaagaagccatattcaaaaggctacatactgtatgattccatctgtcattctagaagaggcaaagctatagagactgattacctataagaagctatagagtcagggattgccaggagataggagttgtgagagggttgtggctgcaaagagaattttggggactgataatggtggtggttgcttgacattatacatttgccaaaacttagagaactgtataccaaaaaagtcagcatcactgtaagtagatttgaaaatattttgagactttgttcaatatcaaaaagtattgagtattcaaatttatagtaaaaataggtaacagttactgagtccttactacatagcaggtattatattaagtgctatgtatagattatctcatttaatataatcttaaaataaccagaagtagtgtttgcagagtcttttcatcattaatttaaaaatatatatttgcttttcacccttttattttttaaaatagccagtcttttttcaagtgtaaaattagttatttcaaaaaataaaaaggaattgttatgtttatatttttatttccttttttgtttatttgccttaatattttagtaatgatattacctgttttcctttattttcttagtatcattttaagccattaaggacactgaattctcttttatctttctttccatatagatttttctaatgtgattgttatccccagtggcttagtaaaacaacccatttactcaaaagctaaatcataaatatttcatctttattttagagtactcattatgcttcagaaatgttttatacttgtctggcaccttttagtaacataaatattctaaaagcacgattcattcttttcctgtcttctcatcatgaagagaatgcccaaactttgatgggtaacttaaaacagtttatacagattgtttaaaacacttctaagaatatataggaagattgctagcttgctgtaatgaatagaagacaaataaatgtttacatttatggacagaatgttaagtagacacagaaagattacatttggctttatggatttggctttgtagccagtgttagaaccagtggatagattttcatgtctttccttatgttgaaaatactttgtggtagcgctggcctgttttttttaacacttgaaagagttaacttccctacaacacaagattgactctaaaattaatttttttccttatgattacagattcagaacagaagaatctaggctttaaattcttgggatcaagttctaacttatttccttataaacattgtaaacatacacaacgtaatattgacccaagggcctgttgagtaaatatttggcccagggccagtgaagtgcatgggaaattgctgcagatgggagagtggaatggaaggcagtctcagaacaggtcaagggtgtttgcttcaatcagattatgtcagtggtaggcagctgcattgagaaagttttgggaactgcctgtgacatttgcagtacccattctataaagaaaataaattcagagaggaagggaaatatgataagatggtcaaagtctgttttatggatggtagtgtcgtggcttcatcttgtgtcattggattttgttctgttttgtcttttaggatatagaatggactcacattgactacttcaataatgctatcatttgtgacctaatagaaaatgtgagtacttaggtacagttttctaaagaatgttttagtcctataattcacccttataaatgttctcagtgcctcaatgttaagcattagtattttcactgttttttatatatatatatatatatatatatacacacacacatatatatgtgtatatatatatatatacacgtacacacacacacacacacacacacacacacacatatatatatatgttaaggaactgcagagttctagagattttattgtagccctaagagatcatacacagttcttgaacacatacatagacagctggatgttttgatacttagccaggatccccagtggccatatcacaacacccttttatgaccttcagacaccaggccttaaaggtaccagcctttcttgtatggttggagcccaggtctattccatgactcctgggcatgtgagtactgatcagagtaggctctgagcagccatccagttttttgccaaatcaaaatatccatttcattcccaaaactctaatgacctcttaacatactattcaccgggtattatattaagtttaagtgacataaagggacaacctctggagctgaattaagtgggaccccagaagtggcttaagtgcagctgtagcattgattcagatcatacatgcagagggcattgcatgtgtgactgcaggtggccagggacctggaatttttcggatgacccaagtatgtgcatatgcaaaaaggcttaaagtgtgaaaaattattggataatttcgagtaagctttctgagtccaagatttttgtttttagatcatattccgtagtttattgtaaatgaattaaatgtaggaagactgattttgtgtgtggaaaacaggaaactaatttatgcttaggattactaatacctgactttgaataagtaatttgaaacagtgtataagccttattatcctgcagtctttttagcaagaccagtttagtgagatgagtgctgtgtttcaggaatacagtcacatgctctgaatgaatattaaatcattttctactcatcttttacaaagctttttgggaaatatgtaattagccagtattttttttcctcagtattcaagatattcctaaaagttgtttctctgattaaattaaacaatattctaaggcatcactatttttcaataagaaataaactgtgtttcaaaaaatctgaacaatattgaatgggaacactaatattccacataagcaattcagatctctgattttggctctgaaaagtgaatttcctgaaaattttcctggtacattttgtgaaggaggtaatttgctatgggaatcttaattttcagaatttctgattagtatgttttctttgataaatataaccttgcatttaattattctcttttaagaagaggagaaaaagaacagtggtaatacacttaatttaactagattatctcagccaaaaatccccttgctatatgattgaagaagctcatgttcacataggaacctgggtatataaaggaaatgtttccttccagcatcattaaacaataatgtttgttctggggatgttatgaacacacttgattcctgagagtccacgcttccccagggttttgtgtggaatgaataaatgctggtcagaggatgtcgtggccttgttagcagaaggggagaggaacagaggactttgcctgggtggaagtaggtggggttgatggtcagtggagtggattgtttttggaattaagacttatgaccccataggggcagtccatggagtagcagtctttatttagcaaagtagaagcttcctgacttctgattcagtttagggctgactactcttggaataaaaatgaccacagggtctagatatgcaacaaataaattttcacttatgtttaacatccatttagaaattccacatgaatttctaaaatctaaatctatatgaaacagatattcttgaaatcagtttgattgcagtgattgttaaaagcagcatctcaaatcacagcatttttttctaggaaataaactttattttgaacacatgaacaatttggaaacatagaaaacgagtttccttcttaggagtgaatcaaataatggccttagaagactgctttgtgatttgagacatgttatagaggctgtattgtcacattcatttctgcttttagatttctttttgaatctttgaggtccaacttgtctttttgtaagagtataaatttcagtcatcatcaggctaaggtgtctgaggcaactcccaggtactgttgttctgtgcgaggagagaggaaccaagaagacacactcttcccaaccacaccaccatacacacacctgggatccttcaggaaagagctgattcctgtggcttttgttattgttttgagtctctgctttttgttataactgaacagacttttcttgtgactaagttgattgtgtttgatggtgtaattaggaataattattaaaacaatatagtgaggaaggaaggaaacttttttatttccgttttcccagaacacaaatggaatcctggccatgctggatgaagagtgcctcagacctggcacagtcactgatgagaccttcttagaaaagctgaaccaagtatgtgccacccaccagcattttgagagcaggatgagcaagtgctctcggttcctcaatgacacgtctctgcctcacagctgcttcaggatccagcattatgctggaaaggtatgggggagctgtgagcacccagtcaggcctgccaagttacccctgcaaggaggctgtacctcagagatgggcgttcgaaaccccattaacttgtgaggacaaattgagctgctaaagtggttgaatcgataaatgttcaatagaaatagaatctggaccatgttgactaaaatcttattaatacagaaaatcaaaagcaaagctaatggacttaatgaagagtctaaatatatttttgaatcatctttattattttcaaactctaagctatcctataaaaaatatctattaacactattgaaggagatttgccagtacaaattaagagtcaataaagacttaaggctttaaaaacacaagccatttagcaaaaataatgaattatttgagattttgaaatgacattagggaaaatatttacttttttaaaacacttatttatttggttaatatttgggggaattaattttatgtctaatatataaagacaatgctaaaaacaatcttaattgattaatctttagaatcctgaaagaatattgattagagctaatacttcctttttcataaaattgcaaacttcaaagggaaaaaaacttcttgattatacatttgtaaaaagtatatagtacctgaattacctttaatttcaaaatgttagaacttggtactttattttttttattagcgtatattattaaaagataatttctgatcagcttttctgctgctcaggatatttatgaaagtgttagtattgtttctattttgccccatctacttttaaacagactagaattggtatgtgagaactaaaaaataaaagtaaaaccccagaatatgttcagactcctaaaaaatgcaaaatcctttgaaaatgttatgataacatttttggagtttattcttgcaaatcctgaatggtaatagaatttattttgatcttgtctgtgatttagacagatggaatttaaacttggaggcgaactcattatgagagtgtgactaacatgtcagggattttttgatggtgaaggaagtggctgcaatgtagatagtcttggagtatttttaatagttgtttgacattatagcatgcaatgtgcctgtcattgagttacatgtgctgcttataggtgctgtaccaggtggaaggattcgttgacaaaaacaatgaccttctctatcgagacctgtcccaagccatgtggaaggccagccatgccctcatcaagtctttgttccccgaagggaatcccgccaagatcaacctgaaaaggcctcctacagcaggctcacagttcaaggcatccgtggccactctgatgaaaaacctacagaccaagaacccaaactatattaggtatttttggcacatgaaactttcacagttcaaatgtgagagcaccccgaaggaatatcatttttccctttgcttcaatctgagtgtagcccaagcagagggtaactaaaatacttacagattaaataataccttatctgggattggcttaaaaaatgctccactatcctttcccctaaaataagaaagtaaaaaagtaaagtgtggtggagaagatagtagatatttaatgaaactcagtggttgagacctaggggttttcaactttctgtatgtttattattatttttttaatggcaagttaaaaaacaaaatgcaagtgttttttctggtcagtgttttgcagaaaactcttgttggcttcatttgggattcttgttctattagcttagagcacagcattgaagcaagtgctttagttaactgctctggcacttcttaggagacatgcacttttttcttccctgtgagaggtgtaggcctggagaaagtaatgattcctaaagcaatctgaatttttttcaaggcagtagaaagaccttcttaaaaagggctgggcgtggtggctcacacctataatcccaacacttagggaggcggaggcaggtggatcacctcaggtcaggaattcgagactagcctggccaacatggcaaaaccctgtctctactaaaaatataaaaattagctgggcgtggtggcaggaacctataatcccaactacttgggaggctgaggcaggagaatcgcttggaggcagaggttgcagtgagccgaggtcacgccactgcactccagcccgggtgacaatacaagactccatctcaaaaaaaaaaaaaaaaggaaaaagccttctgggctcttctctttttctgcttctagggcatcttagacagaactctctctagatttagtaaagaccaactaggattagagtttgctatgtgtgtatttggtgagctagatagtagaaggtatgtgtctggtgggtcagatttcatagagcacacccatacccacaagtaccttctatagttgtctttgaaaatgcagttatgaggaaactagagtgaagaatatttttgtgtttagtttgtgtgcctgatatttatatttacagaaatgtaagtagacaaaaccctctggtttgattgcagtcagattagaacatatgttggagaggatcctagtttaaaaaaaaacccaagaaactttctgtgatgagttgcttttgttattctcaattgaatgaattttttttttgcatcttaactctattttattgaggtatcatttatgtgaagtgatatgcacagatctgaagtgaacagttcaatttttttttaaccattatatatgctttagtaaccaccacccaggttaagacgtaaaacatttccattaccccagaaagcttcttcattcccctcctttttttatttttacagcttttctaagaaatcttaattaataaaccccaaggttgtgaatatattatcgtatattttcttctagaagctttatagtttcagatttcatatttaggtctgtttcccccccatgtagatatcctgttgcactaataccatattgaaaacagtcttcttttcccattgatttgctttgtggcctttattgataatctgttgaatgtatatgtagggatctgaacttactaggccattccatttatctatttgtccatctttatttaagccaaagagtagacattatttttataaatggtaaaagagaaagcatagtaacactgatgccaaactagctaagatgtagttgtccacgtaagtgtgtaatttcacagttgtagttaggcagccataatcatgaatgtttaagtattagttaggacacagggattgctgcagtatgatccaaagctagcaatgatttaagcaagattgatgtttatttcttaagtaacttctaagtatgaggactccagagctgacagggcagctccttctgttttgtggctctgccgtttcctgggcgtgttcctcgtctgcatggaggaagatggctgtccaccgtgtcaacatttgcagccagcagtaagctggaggagacgaaggggagtgcctgtcccttcttctaagaacactgactagaggctgcagacattacttcccctctgatcctagtggccagaagttgctcacctggccacatctacttgcaaaggaggttgggaaataaagtttttccctgggcagcaaagtgccctgttaagaaaggagaacagatatagggaggaaacagtgttttttatctttttattgaggtataatacacatacattaaagtgcatggatcttaactgtacagcttcttgaagttttacagatgtatgtacttgtgttaccccatccagaccaagtggtaaaacattcccgtcagtccagaagattcccttgtgtcccttgcatgttgatcccccactactacctctccccagaggtaacagcaatactgatttttaaccatgggttagttttgcttgaacttgatataaatggaatcataactacagcatgtactcttgtgttgggcttcttttcactcaatgaaatgtcagtgatacttatccacattattgcatttattagtgtgttctttttaaaattactgtgcctgcagtattgtatttatttttaggtggttataaaatgatttgaaataatttcaaaagtaatgactaggtttcttaagaataacataattgttttgctatgaaacagttatatataatactttgtgaaaacatagacaattatatccataggaggcagtttataacctaaaatctttgtgatctttaaggtgtatcaaaccgaatgataaaaaagcagcacacatcttcaacgaggctctagtgtgtcatcagatcaggtacctggggcttttggagaacgtccgagtgcggagggcaggctacgccttcaggcaggcctatgaaccttgcctagaaagatacaaaatgctttgtaaacaaacatggcctcattggaaaggaccagccaggtaagaaattcagtgaccatatttaataatgaatgttttaagtggtcaaataatacggtgttttttcacatgctgttagataaaacagaattttatgaaaaactggatgtaacctctgttttggaccttcttccattaggataccattttgtgctaaggtcaaaataagacttaccaaatccacatttgggacttgtatggcaataatattaatttttagaatatgcccaaggtaggttcgtaggaggtggtttgtaatttgatacacttatatttgtgtagaatcatagaagggtagaattagagacaggttggattaccacttgtcacttttcccatgaagaatttggctgcagagagaatcagtggatgggtgaaggtccctctctttgcctatatctataccagttaatcaatagacgatacgagcaggtaggattcacagtgtcagcattactgctaggagagctggattagagaacgtagcttggacccagggccatacagctttcagctggtctgtcctgaattgcatttactcatccagtcccagacagagtgctggacaccgcaggcccagtggtgcatccccatgtcctgtgagctctccacaggcagagagaactgtgtactgacgggcggctgttgcaggagagaaatcaagccttattccttctgccctcaccagagaggctgctcctctgcaggctgaagaaggcttgcccctgaatactgctggagggctgacatgcctgtttcatgggcctaggcaggaaatgggcgattttcatttaactgtactggtattgcctacacattattctcactgcacctggcctttcacaggaacatcaacacacctaggacacttaccttgtattataagaagatctagaaactccagatgtatggtgcggtctctgatgcctaatttagtaccctaatttaatgtaggatttgggtactgtttcagttcccattgctaatttccggggtattatggtaaacaggtaccataatacagaatgtgtattcactccctgcctggcatctagtctgcaggtgggtggagtgaggtttagttctaaagactgatgttgaaaccggggtccaggatggagaggtcagggccaagtccagttcttgctcccgctgggtaaggcccacgttccttagcgtcccgttggtctgggactgtttcttggtctctgcttttattctcaggggcagaaacaatgtttaaaatattttcaggaattaactgagtgagtttaaaatagatctgaatttcttgcacaccctcctggcccaggttggtacatcattataggtatttttgatacaagtattgcctctactaatgaaatcaagaaattggctttaataccacattttcttagaatacatagttatgaacccaaatttactttttcagtgtttactggattaagtttaatttgtggaaaattctttgataaatggatgattgctgaaagagcaattacacttggaaatgaagctatgttttataccactgagaacctgataccatgatagaagataaaactatttttgtaactcagaaaactcactgtttttatttttatttttttaggtctggtgtggaggtcctatttaatgaattagaaattcccgtggaagaatactcctttggtagatcaaagatattcatccgaaacccaagaacagtatgtaacgaaaacctttacactctgaacttaagttggaatcgtataggaaagttcttaaaatatgtttaactttataacattatatgaggggccaccatgaatgccacaaaacacttgtgtgtttatctacaaataatcaagaggcagggacagataagggtaaggggcggtagaagaatgcgtattttttatgaaccatcaaagtctttgctctgacagattgtacaacacttaagaaatcacaaagaaactgttaggacaacggtgcaacattcatagcaactgcaggtaaacagtctgtatttgtaatacctgaattatacattaattttaagaactacagccccattatttagaggtacaggaaagcactaaaatgaaaattttttttaagttaaaaaaaatacttttagcattctacctcatagaaccccaaggaaatttttttgtcaatgaatagatgagtgtgaagtgtaatgagtatagcaggtgactggtaatttggaaacgttaagattttggaaagtatttaattcatttaagagaattttccagcatctaccttccattagtaatttgcatcctcatagacagtgtgaaggtaaacttaaggtcaattcagcccctctctgatttgtcataaattctgaatcactggaataaaaattgtaagtctttcatgaatccatcaaaataattttctcatggaccattatccatatcatatataatgcatatggtttttcagttctttttttcaatgtaattgactccaacatgatggcattttgtctcctgaaaattcctttcctgtatgctgtgaggtttcagaggatttttgataagtccatctatcatttcttattagttattcaaattagaagacctgaggaagcaacgcctggaggacttggccactctcattcagaagatatatcgggggtggaaatgccgcacacacttcctgctaatgaaaaaaagccaaattgtgattgccgcctggtacaggagatatgcggtaagagtctcagtcattttaaatcagtaataacaatgctaatttgccaacatttattatgtacttaccatgtatgtgatttttacatacttaattctcccaacaacctcatgagataatggatgttcttaatggttcttttttttaaagatgagaaaactaagacacaaagctgttaagtaatttgcccacagccacatagctataagtggtagagctgggatttgaatccaagacagtattagagctcaagttcagtgtgccataccgcctttcactgatctagctgtatttggttggaaatacatttttaatttggtcatcagattggaagagacaatatcctttaagcttttgatttggttgggctagtttttcaaagtaattggctattctttggctattctttattgtagcagctttgaaagtggctttaattccagaaagctaatgccatgtttttgtagatttctggttttggttaaaggattgcattctctttagtccttaggtatctggctctattaactatagggaaagattcaataataaataatgtttacctagttaatatgaaatttctttttggcatttccttcctcatttgattgtagagattttgttgaaggcataccacaggtatgagagaagcctgaaggtttgcctcagggttaattgaaacttgggctgtgttctcacaaaatgaattaagtttgcactcacatctcctttcttatattcttcctctttttcagccataaagagactttgctatagggctgtatataatcaagacataatttacgctgacctattctcacataatacattttagtttattatttccaagttttacaaattaatgaggtatttaattgattaagctaaagaaaatcagcttgagagtatctttacaatggctcatgctagttaagattataaccagcagtataagtcttaaaatatgagtctgcccagccatgtgaatgatagagtcattcatatgcattctgcagaggcactttggactgttgtcacccagcctggtggccgtggagtctcctctgtacacatagtaccactccttaactctgctgcagattcataatgctccgttttctgttagcctgagaaagggaggaccaacaagaggaccaaaaagtcctcaaggagccctttttataatttcttattttgaggtcattaagaaaagtttacaagtgtgctggattcatctgtcttgaattctacaaatatttttgaaacacattagcaaggtggacaaaacaacctaattcctgacttcctaaagtttatatctagtgaaagacaatacgcatttaagcaaacaaataatcagaaaaattatagactgttgtaagtgctaggaaggaaatagagaactgccataaagaataatggggaggcgggatgtgacctaagctagagtggtcaaggagaaacttcggggaggggccatttgatcggaaggatgagaaagaacaggcaatgcaaaggaagctcaagtactatttgtaccttttctcccaatataaagcttttatatcatcagattttaaaaagtcacgatttatcattagttcatgatgtcaggagttatgagcaatattagttggtagaatgaaaactaataatagccccagttttagagaatgcattaactttgttctaatgttacatctctttcaaaatttgaactacatacctcaaccagttcactacatgttactcaagccagtggttaaactcattattttccctcaaccagataactcaaaagatttcttgaatgctcctttttagttgctgattacttttaagttattccgtattttgtaatatttcatgtttcctagagatgaattttcaagtgagatatacttattttcaagacatttattaattaaaaaggaaaacacagaggtaccaaatgcgtgtcagaatgatggtcagatactgtagctgttctacagctacatctgtggaatattactctggggagaatcctagagattttccacctcttcatttaacagctggggaaactgaggcccagagaaggtgagtggcttgtctgaggtcccagggtcctcttggattttctccctggcatccttttttgttcctctgcccatctattgataccatcacccattacctctgatcttccaagacatagcctggtagcctgggaaggcatctctcccgcctcagagaaggggggctgagccagctggcacttctaacatgagggattcacaatgtgactttagtacttcgaaatgctgtgaattttcattagggatgcccccatgtttcagtgtatattccaaagtgaatactgtaaaagctcacttttctagggagtattccagcagcctccactccagggcgtcagccctagaagtaagaaaggcctctgggcattgagcttgttgagccagagctgggagcctcactaggtcttctttgaccttccccacctggaagtaacctctgctgcctctgagcctgactgttgtgctttctgtgctgcatctctcccagggtactgtttatcctttatactgttgacctgtgttcacttcaactccttgagggcagggatgcagtcagatgcacatttatatcctcatggtcctattaaaaggctttatgcatagtagaggctcaatatataaatatttaattgattgatagcagtttacttaaatttttagctgattttccagcttgaggcagagtaaaagtagcaaacctaaaagaaactagggaggtttagaggtgggtccagtaagtagcatggtgagaaatgacaccaagaagagagaacactcaaaagcagatgcagaactcagtgggttttcattcaatatgcatttactgagtatctgccttgtgtggaaccctgtattataacagcatgagatgaagaaaataatgataataatgctgtgtcctgagtcatttaggaattattttatttagcatccttaaagcatactttggattaactgtaataatattggattgtttgatattttggtttctttatgtattggtttccagaaggagtatggataattgagtcagttagacgaagtgagcaaataccctttctcaatccttgtatgcgttacagatattaactacaactgccaatatcttccccttttatcctacagcaacaaaagaggtaccagcagacaaagagttccgccttagtaattcagtcttatatccggggttggaaggtgagtttaaaagaagtatgctttatttattttgggttttctggtttttcacaaaggataatgtctttagggtcaccctgcagaggaggggctcctctgtctcctgcctcgcctgtaaacagtcagatggaaagaataaatattatgggccaaacggggaccctggtgaccatgtcttggccacttccttctaaccagctttctttttaagcgctttgttctctaagcaggaagtccttgaaataatacccgtacatgatttcagtatccctttgccccgtgttttcgagaaaagctgtggtacagaaggctatctcacagccattgctttcatactcagaatccctaccccagtgacttccgtaactgtccagtaaccatcttgcaggctacccatcacgattgaaagatcctgagatctggccaggtctagtggtggggacatggaggagccgtcacagtggacagcctggttctaggtccttgctgccaaggcttggttcaagggtcactgaactacaggccacaggctacagctagcctgcttgcgtgttctcatacaacctgcaagctaagaatggtttttatatttttaaccgttgtttttaaaaaagcaaaagaagatgatttctttttttttttttttttttttttttttttgtaggtgggatgtattttttttattttttattttattttatttatttttttttaattgaccattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgacttcaagcatctgtttaacaaagcacatcttgcaccgcccttaatccatttaaccctgagtggacacagcacacgtttcagagagcacagggttagggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcgtctggccgggcggggggctgaccaccccaccaccctcccagacggggcggctggccaggcagaggggctcctcacttcccagtaggggcggccgggcagaggcgcccctcacctcccggacagggcggctggccgggcgggccgacccccccacctccctcccggacggggcggctggccgggcagaggggtcctcacttcccagtaggggcggccgggcagaggcgcccctcacctcccggacggggcggccggctggagacggctaacccccccatctccctcacggacggggcggatggccgggcagaggggctcctcacttcccagtaggggcggccgggcagaggcgcccctcacctccggacggggcggctggccaggcggggggctgatccccccaccatcctcccggatggggcggctggccgggcagggggctgaccccccctcccccctcccggacggggcggctggccgggcggggggctgaccccccacctccctcctgggctgggcggctggccgggcaggggggctcctcacttcccagtaggggcggctgggcagaggagcccctcacctcccggacggggcggctggccgggcggggggctgacccccccccacctccctcccggacggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggcgctccccactcagatgatgggcgggtcaggcagagatgctcctcacttcctagatgggatggcggcggggaagaggcgctcctcgcttcctagatgggatggcggccgggcagagacgctcctcactttccagactgggcagccaggcagaggggctcctcacctcccagacgatgggcggccaggcagagacgctcctcacttcccagacggggtggcggccgggcagaggctgtaatctcggctctttgggaggccaaggcaggcggctgggaggtgtaggttgtagtgagctgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaacgaaaaccagtcaggcgtggcggcacgcacctgcaatcgcaggcactcggcaggctgaggcaggagaatcaggcagggaggttgcagtgagctgagatggcagcagtaccatccagctttggctcggcatcagagggagaccgtggaaggagaccgtggggagagggagagggagagggagagggagagggagagggagagggaggaagatgatttcatgacatatgaaaagtatatggaatagagatttcagtgtacataaataaagttttattggaacacagccacattcatttatttcacagattgtctggctgctgtagcactacagtggtagagtcaagtagtagcgatagactgtgtgaccttcagagccaaaagcagttaccatctggcattttacagaaaaagtttactgatccctgatctaggtcaacgatacttcagagcctgttctgaccactttcctgtgaggagactttgtggtatggtctggatccagaggggtagtgcccaggcctggagccctttcagagggtagacgctgggtcccgagtccagcaacactgactgaccttgcccaggccctcgacaacttaagggcttagcagttgtctcacagcaaatggcaaaacacaaatctgaacatgtagagtaagtgaaactgctgcctgcaggctcttccttggcctcatggctggaccttggggccccgtttataggcgagagaccttagaggaaggacccaaagtccaccttgaaaccaggtgtcctcctggcccccataaaatcagtttccagcaactaatggaaagaagtcactggtttgggatcaatgagatcattttggttttggagttttaaaaatatcttgaataaaaaggacagctacagttacattccaggcaataataatgaaagagatacagtggcctttagaggatcattggaatcctctggcccctttctgagaactgtttcatcccacagatgtgtgccagcttgtggtgctgtagtcagatttttcccattgtgtatcagggtacgggaggctgctgttccaatcaagtggaaacccatgcttaatgatgtcttcattgtccaccttctcatagtcagtttggggctagtcaccttcgccttctttaacctgttgatttatcacaatagcatgggtgttaggacgatcatctcttcaggtttttttttcaagtcactgtcaattcctttatttttaaacattctctcttttgggtgattctgccctttaggctcgaaaaattctgcgggaactgaagcatcaaaagcgctgtaaggaagcagtcacgaccattgctgcatattggcatgggacccaggtaggcccgagaccccaaggaaggcggtgggtcagcagtaacgtcatgtggaaccatgaaccctcggcttcaggggcagaaaatgtttcactggcttgagctactgagcacgtgtttgcttcttgctctttccaacattttgttgtggggtggtggcacatgcttttgcgtttaccatttggtggtgactagtgtctctctttttctttcttcattgaaaaccagcagtaacctttcctgccttaaacttttctgtaactccttttcaaatgcatcacaggcacgaagggaactgagacggctgaaggaggaggctaggaataaacatgctattgcagttatttgggcttactggcttggatctaaggtacttgatgcacatatcccaacactccatcctggaattctgcaataatcagtccttacctctagcctattaggggatgaatgactacaattaatagtggctcacactggtgcatgtcctagccgccagatttaacacacctggaaacattagttcagtagtatgcataggaagcttaggcatgcataggtcaataaaactaattgcttactaaaaaggcactagtatcattgctctttaaaacaaaacaaaacaaaacaactcttaaataacatgcatgtttaggttcccccccgcccccattgatgaatgctagcagttttttagaggttttctggaggggttgcgcatgttgggaatgttcaagtttgggcttcagtcggtcttctgcaacatgttgacaatggaaatgcctctaacatatgtcttaaaaatattaatttatgaatgaaatttttttttaggctcagtgtggcagctattgattattataagcaaaatattacatgtgcaaagaattatcatctgtgatttaacagaaaactatgttcatgcacagctagctatgattgccactgaagaatcccaggaatttcagcatcagctgtttgttttcagaaacaaaggcctcctgaaatactctcactaatccccaggcatagtcgtgggctctgtgaacatttcacataccccaagggacaagatttttagatgtttttgttacttagaaaatcaaagtcatctttgctaaaaatgtgtattccagttagaaacacaaacatcaacagagtcctgtgttttgaagtccaccttgtcaatgttgtaagcctatcttatgagaaaatgagaaaagtcaacatctgcctgcataaagagctaatttgccaaaaactaaccagagttgttcatctgtgcttttcctgaaaatctgtgaagaacaaacttgttcctctagtcaactgagggaaatgtcatagcagaagcaaaaggactcttaggtgggtcttgctaagatttctccatccagtgagttcatttcccagtctcagtactataatatcttgaacaatcagtgcctatttgtatcctttagaatagcttgcctaagattattttttccctaagagtaatttttaaacctataagtttaacctataattgcttcagtcttcctgtatattttacttttgcgaccttagctaaaattgaatttttacacgtgccagttttcattttttgactggaaggaatttttgagttttgttagttttggtttttgtttgcacttcagagaaataaacttttttcctcccagttttctaagtgattgttcacaagagttgtctttttatccatccaaagggatgaactcaggagtgcatagcttcttcagcccaatgtgctgtcagcaaaggggagtctaatgacatcattagggctgttactcagagtttgaaggctttgatatgggagtgaaagagtgtggagaaggcagcgaacagagagagagaacaggagaaaaaaggaaaggaatggaagtgaggggtgggaaatgattaccttgggaaccacacagattgtccttctctggaacagaatctcagtgcactgaaaatataagcgctgcaccagcctgacaccaattctttgggtttaaattgttatgcactgttcctctgtcattctgaaatccttattcataaattggctcttctgtttggtgggatatctttttctggtcatttgtgctgtctgcattgggctgtctcttttatttactatctaaaacattctaggctcgaagggaattgaaacgcttgaaggaggaggctaggcgtaagcatgcagttgctgtcatttgggcttactggcttggactgaaggtacttcctcaaccacttgtttctgtccagggtgaacttcataaagcctagcacctactaaccctgagaaaatgattgattatgcttgctgatggtctgcacagtcttgtagaatgtcatcttgcttaattttgtacctttttcagaagaaacctatacactaatttttttctgattttgtgatttctatttctttaaataataggtttaatgtaatagcaatatggcatgttttattcaagatactatgttatcaaagttctagtttgttatctttatgagtgtaaagttgtttttttaaaatctgtgagacacagttacaatagttgagctaaaagctgccctacatccacagtgaccagcctagggatgccaggcttttgtttccctttttgtaccaattctgctccaataatggctgcctgcagtagagctttcttcagagcgaccattgttctaattgttcagcgttggaaccaaagggtcttgcatcattaagcttacagattttgatgaatgagttcagagattcagagatcagtggatcattcatgttaaagagaacctcgaattcaaataccttgtgattatggcagggtttattttgaagtggtgcttactacagtagggtacacttatgtgtacagaactacacataagtaaataactctgagctctgagaagcccttagaatattctttacaccatgtaaggatctgatcttccaaattcaataattagtcaccataggaagccatccatattgcctttttgggataattaggcccctttctgacagtattccttatcattgtttttactttaatcctatgacatttaatcttactccaaatatttgaattattatctgagtaatcattgactctaagtctgaacaaccattagaaatatccctgaatcctgctttgaacaatctgcattttttttctgcaatttcagcctataaactttagtaaattatcctttttgattatactgaatattcaccaagtaatatttgaagtaattaagaagtaacttaaatatgaattttaacagatgttctatttgaagaactccaaacaagctctataaccggtttttttaagtcaaacaaaagtaaacattttcccatttaactcacatctttagttttctgggtttaactgcatatgatttcaaaacatttttgcattaggggtgtacactagcaacctacaaagcaaattcagtttgtaggggaatattattttagcagaagttaactgggcttactctagacataacttttttcctctcagtctccaacaaaacagaggtactttactatataaccagtattattgtatgaaataagatcaaacttacttgaagtccaagaatataataattttgtactttttttttctaaaagagaatcatgttaatatgaatgataattttgccctctcaaatgattgacttttcctgtggaaataattacaaagtgcagtgggcctttttaagactcccagttccccagggggcaccatcgtatatgccagcatgttgtcaccaggcttttagtgtctgtagtggtattttgggagaaataacctgccctgtcgaatatcaaaatgcatatagcaatgagctcagttatgaggctcaactaaatatcgtatgacttcaggtatatttttaatgatatattcttatgtaacttcatttgtctgctttcctatactattataatttcaggagccaattattaggtaacatttttcttctccttgtcccttctcaccttagtttgagattagaaatgtttgtggatctgacagctctgtggctaaaagacagatgataatcagtaactagaatatgaatacaggcatacctcagagatattgcaggctcagttccagatctctgcaataaagtgaatatcacaataaagtgaatcacacaaatgttttgtttgccagtgcaaataaaagttatgtttacactgtctctactgtagtctattaagtatctaatagccttatgtctaaaaagccaaagtacatactttacaaatacttcattgctaaaaaatgctaaccatcatctgagccttcagcaagttgtaatctttttgctggtggagagtcttggcttatcttgatgtcgatggctgctgactgatgagggtggtggctgctgaaggttgtggtggctgtggcaatttcttaaaataagataacaatgaaatttgccacatagattgacttcctttcctgaaagatttctgtatagcatatgttggcatttgatagcattttacccagtgtagaacttctttcaaaattgaaatgaatcctctcaaaccttgccactggttttgtcaactaagcttatggaatattccaaatcctttgttgtcatttcagcagtgttcacagcatcttcatcaggagtagattccatctcaggaaactactttatttggtcatccataagaagcaactccttgttcatttccatcttatcttgagattgcagcaattcagtcccatcttcaggtttcacttctaattctagttgttactatatctgccacatctgcagttacttcctccactaaagttgtgagccccctccaagtcatccatgagagttggaatcaacttcttccaaacttctattaatgtggctgttttgacctcctcccatgaatctggaatattcttaatggcatccagactgatgactcttttctggaaagtttttaatttactttgcccagatccaccagaggaatcactgtctatggcaggtatagccttataaaatgtatttcttaaatcataagactgggaattactccttgatccatgagctgcagaatggatgttgtgttagcaggcatgaaaacattaatctcctcgtatatctccatcagagctcttgggtgaccaggtgccttgtcagtgtgcatgaatattttgaaagttctctcttttctgagcagtaggtctcaatatggggcttaagatagtcagtaaaccatgctgtaagcagatgtgctgtcatccaggctttgttgttccatttatggagcacacaggcggagtagatttagcataattcctaagctgtaggatttttataatggtaaatgagcattagctccaacttaaagttagcagctgtattattctttaacaagagaatcaacctgtcctttgaagccagacattagcttttcctctctagctatgaaagtctagatggcatcttcttccaatagcaggctgttttgtctacattggaaatctgttgtcgagtgtagccacattcatgagtgatctagttagatcttctggataactttctgcagcttctctatcagcacttgctgcttctttccttaaccttcatgaaaagttaataaacttttcttctgcagcttcctcacctctctcagccttcttggaactgaagagagttaggacattgctctggattaggcattgcttagaggatattgtggctggtttgatcttatatctagaccactaaaattttctccttatcagcaatgaagctgtttcacttccttatcatttgtatgttcactggaataacacttttaatttccttcaagaatgtttcctttgcatttataacttggctgtttggcacaagggtcctagcttttggcctgcctcagctgttgacatgccttcctcactaagcttaatcatttctagctttcaatttaaagtaagaagtgtgtgacccttcctttcagttgaacactgagaagccattgtaggattattaattcaatattaattaatttctatattgctctgtcttagggaataagggaggcccgaggagagggagagagatgggagaatggccaatgggtggagcagtcagaatacacacactgtctcttgattaagttcaccatcttacagatagaaaaataatgaaaaagtttgaaatattgtgagaattatcaaaatgtgacagacacagaatgagcacatgctgttggaaaaatggtgccaataggcttgtttgatgcagggttgccacaaaccttcaatttgtaaaaactcaatgtctgcaaagtgcattaaaatgaggtatgcctgtaaaaagaaaaactgcctataaggtatatgttacagtttttaaaccttaacagtctttagaggtagagaatgggtctggtgcaaaaatgctcagagggaccaggttggtcgtacagatgaggaaagcatcagatgggaggtggatcagaagcaaagggactcgtgtagtttggagcgtgcatgcctcatctaaaggcaacagcagctactttggtctccctggcacttattttataggactaggcctcagtgttgctagatcttagacaactttaagagaaatctgcagtctgaattgttatattgagttcttaacttaaaaatatgcatacagaacatttatctgtaaactgaatttggatagaagattactagcttacatcccgtaatgtagaaatattttgaacatgtgcagttaaacctagaaaactagaaagaaaagaaaaaagatatgtaatatctgaattattcagataggctaatattttgctaaattctaactctcccatttgtatctggatggtaataaatacttaagatatttttccttcaatttcaaaatttaactatataatttattcatttgttatacaaacactccactttgttactgttatttgttagacattagtatatgaagtaaatataacaatgtagcaaggaaaaaatgtgtgaactaaaactataatatgatgttttaagtgctctgatagcattaagtataaagtttggtgggagtagagatgatagagaagaattaatgcaatgaaatggaagataatggtagtttcaaagcttctatttaaattcttagccatattcagttctcagtgtgtaggccttatcttctatgcaaggcttttggaaactgatacagttcttcagactttttttttctttttgccttttacaaaacaatctgaagagaacattattttatataatttttaatgtattttaattggggatgagtttgcagctgtgcctgtaaaatgtttcttgtcaaatcatcagattcttcaaaaactactaagaggatttaaaacatcaattcatgctggtttcatcattttacatttcttaatttctttctctctgacttaagatccactatatgaatgtgtttcaattattttactaaatctagaaaggacacttataaactgacttgtttgacattttttcatttttaatagaggtgtatcattatggacctgtaccagccacacattaaccactgtaacctacatcttctttttaaaggtacgtagagaatacaggaaattcttcagagccaatgctggaaagaaaatctatgagtttacgcttcagagaattgtaagttgacactttatatctgtggataatcagcattgtggaattacccacctaatatcaccaactccataaaatgtgccttttcctaaatgacaaaagtgactttttaaataataattaaatcatagctgtgacactgagagttagttatcttttaaaatcatcttcttccaaattctggtagaattgtgtcagaaagagttgttaatggcccgtatattattaatacagtgtttgccttatttgacaagagagaacttttgggggaaagtggatccaagaaagccatgactttaccctgtgaaactgccatgagctgtggcagggcaaggctggcaagcaaattagtggggagaggggtgacagggagccaggctgtgcagctccacccacatggactctggagttctccatctttcagagaggtgtatgtagtgctgaacagactgcaaactctggagccagcccccactgccacttagtgtgactaaggaactggattttaaaatttaatttaattttagttacttaaaatgtaaatataaatagcctgtgtgactagtggctgcattttagacaatacagctctatagagctagctggtattagcattagtgttaatatgagtgttagcattactattcttcttttctcttaaccatttggtagaactcatatttccccaaccagtatgaaagagtggagtagagacttcccagatgagttacagttctataaattccaaagttaaataaattctactattgtctcgtttatttgatcatgatgtatgtaaaacagtgtcttttgtggtatattttcctcatgtagtattttctgtcaacccaacacaggtgcaaaaatacttcttggaaatgaaaaataagatgccttccttatctccaatagacaagaattggccctcaagaccttacttattcttggattctactcacaaggagctaaaaaggattttccacttgtggagggtaaaaaatgtcatattacatcttttcggagactttcttatttattttgagtgtttaaaaacacataaaatcaaaactgttaacacattcttcctttgcctcaaagaggattacttgaggactttggtgattttcccccatgcaccatattgagtttctacgagagcccctgcagcggcccaggcgttccctgtgcggtcgcctctcggccctggctggaacggggagcacagggctgcattttctttccattccaggttccagctgctctcaagtagttcagttttttgttcatttgtttctctctttgtctaaaggaatactgtaggacagagaaatcataaaatttggacaccttcaggcaacatagttaaatcctgcaaattgaagagtttactttatcagatgtacagaacagataatcagataatacatgtgaacacacacactttgatgggtgggaaaaaaggctttttcctgtccctaaagatagtaacacattctctatctaaattacagggaagctggaaatctgttttatactgccttttattttagctctcttattttgtataagaggacatggcatgtaatttagatgttgcccagcatggaacacgtggggcacttgtatagatgttgaccttacttcgataacctagtcagttgatatgtggaatgttaaatatatgcagttatcagatgtaataaaatcatgagatggaagggcatgtatttagtaaatgaatgctcagtacacacatcctccaggaaactttcctgcccagcacggtgggcttgtttttttgttagaatcatctatgtatagagtgacattattgctgattagcttgataagtggtaccatacaacataaggaactagattctgagttctgttctctaacagcaaatttggcgaggttcatgaacctcttaatggcttgtctcctttcttgagtctaacccagaaactgttttcagaaataatgacagggagctcccattgctggggatctgcaccacctctgccctcccctggctttgcaatctcacccatccctccattggattggaggtgggagatgagggctgtttattcctgaagggagcctttccatggaaagggtcagcagcaatgctcacacttcttcatgcaattatttcagtagcacttgaccacacctgtaactgaatttctaggaatgctcatctaaaaaacctggccctgctcctctggccactgtctcctctcattgcagcttcagggatggagtgaaaggggatatctcaggtccctcatccctattgtaaaatggtagtggggggatttggagcagtggttttcaaactgtcatagcatatttgtggtcatgaaatcaatttagtggattactaccagcgtttttcaataaaatgcaatagaatagaaaatagcagagtgtacaatatatagaaaggattgagtattgttttgtgacgcttttgtgtcagttttctctgtatgtgtgtggaaatgtgcttagtggattgtgatgcacaatatttttactgtgagtctctctagaagagtgacagcctcaggactagaggatttccaaggattgacatagtgggaggaaatagtacttgcaaggcccgtgcccactaggccctggtgtgttttgaagaagcattccaggttctgcaatacaaataatactctgacgttttccaagacaaactttttaaaacccacaagggaaaaatgtttttggccttttttagtgaatgttttgtactttctcccttattcttgttgctgataaattgtcttagcatatttaagaatgagtaataatttatttatataaatgatgttttgtttctttcttctcatatctcacagtgtaaaaaatacagggaccaattcacagaccagcagaaacttatttatgaagagaaactagaagccagtgaactcttcaaagacaagaaggctttatacccatctaggtattatggctttgctttacccataaaattcaggattataaaagtttctcaagtatatttgtacgccgttttgcctggtgtttgatttcagtcttagatgagtgatttttagttctgtgaatcattttataatcagcttgatgtaaacacatttatttgagctatggcttctatagtgcagtttaatgaaatgaggttacgattgttggtttcactccattagcattagctcaaacactttactaaataattagaagtcatttaacataaaaattatataggctgttaagatacgtttgcattgtaaattcctgttccttttccgtagttttcaaagactagccaaatttctgttggcaatatactttaatcaccattccagtcttcctgccatagcaagcaaggtcagaaacttatttgtaaggtaaatgaaagagcgagccaggacagtactttttgagtgttgcttgagcactggtctgtggtgccctttggtctgctaactcaacggatatgacttctgtggcctgtacagcacgttcagttcctttattttagacaccgtggactcagaaaaagaaggaacaccaatcccaagttcagcaagtgaagtccttggtaaagactgtttatcccaatagtcttacatctcctgcattcatcacttcctcccagcaatctaatcccattttcatctggtgtttataaaaaagtagattgtacaatttcaagccaaatctgtaacaactttaagcttcttccaatgaatggccaaagaaagaatgtattatatgctgagtatattcacatttattacgtaaattatgtttatattctctgtgactttatacacatttaaaatatcttccttttaaaggattaaaggaatatacattgccagactcactgggtttaaatattttaaattgtacaacttcattggttagctgatgtggctacttgaggtgatacatactcccttaagtcaaacacagtgtctaaatccaaagttgtccaaagtgcctgttatataaagcatattcaaacaggagaatttgtctgtatgcttgcttcagcaactaattttattcagctttttttttatacatttttaaattagggaataaccttcttaatgaacatttcctgtggatgactcttcagaaactacaggctggaaaatacatctttgaggaaacaatttaaaagcctgttagcatttttataatttaaaacacagttgaataggaaccaaaaaaagttaacttcaagccaagtcctttttgggtagtcttatcagttttcagggatagtggcacactcaccccacagcagtgagagaggtggaataatttagcctcccaccaccctgcaaagtggcagctcttatgggagttggccttttatatcctgagagctgtgaaacgctgaccacctacgtggatttttcttcccttatcctccacccacaacataagcatttaaatttgtatttgcaaattgccagaactttgtagctcaaaatgaagcttatagattccttgaagcagcagtttttccttggtgcctttgatgaacctgtcctgaaagagtcccccgacaagtctttagggaaattgatatcttagtgataagtgtacagttaaccttttacaaaaattagtttgtttgggaaaaaaaaaattgccctgattctgaatgtttgctttggttacttctgtccatttagaggcatattctaggagaagaggcttgattctcctttcatatacagatgctgcttaacttatgatgcagttacacacagataatccatcatatgggttatgagtgatttctatcttgattgttccatgtgatgagattattatcaaagtcctgcccaccaaatgccatgatcacctcaaaaatatatttgaaataggtttaaggtttcatttccaacttatatttaggacagatgcaagcgtaatgtataaaataaattgaagtcaatttttatgaagttgtcatatgtcatatgaagttgaaaatatcataagttgaaaatgcatttaatacacctaacctactgaacacaatcacttagcctagcctaccttaaacatgctcagcacacttacattagcctacagttgggcaaaatcatctaacacaaagcctgttttataataaagtgttggatatctcatgtggtttattgaccactgtactgaaagtgaaaaacagaatggtttatgagcaccactgtaaagctgaaaaaccctaagtcaaaccaagtcagagaccatctgtattgcctacttagaaccacagttacatgttaatattaagtgttctatagttttcttctaaagtgattgccctggatctgttctttcccagaaggcctattgattttcttattctctgcaagaaatgaaatttttctttagagcaggtgatggtaatgatttcagctcttttcactgccacatattgtttgaaggcgttagtaaatcctttgtgagcagctgttaactttatattaacagattagaagaaattgccttttccttcacatgaggccatgtacttgagtcttagctgttgttcttatgagtgatttctgtcttgattgttccgtgtgataagattattatcaaagtcctgcccaccaaatgccatgatcaccccaaaagtgtatttgaaataggtttaaggtttcatttccaacttatatttaggacagatgtaagtgtaatatataaaataaattgaaatcaatttttatgaagttgtcagctactccttagaatcaactgacctgtttcctttttttagtggtactttcatttgaaactatttctaatgtgcaggaatttttttcctttagtgttgggcaaccattccaaggggcttacctggaaatcaacaagaaccccaagtataagaaactcaaagatgccattgaagaaaagatcatcattgctgaagtcgtgaacaaaattaaccgtgctaatgggaaggtaaaaatgctaaccttgaagactgataagaagtacctattagttgggatagtcaccctgttttctgaatgtaaaaatttgcatttcatgttctcagtagagttaactatgaaggcggctatttccccttacctttaagcttaggtggaattttgcttgttctctgacatttttatgaaataaaacatattatttatgttctttactgcgttcttggtttacataggtatgtttgttgaaggatattggaatttttgcaaataatgccttaaactcatggaccatttttgagtatttgtgatcattggttttatactattttttattttgatttagagtacatctcggattttcctcttaacaaacaataatctccttcttgctgaccaaaagtctggacaaatcaagtcagaggttccattggtggatgtgaccaaggtatcaatgagctcacaaaatgatggcttcttcgccgtccacctcaaagaggtaaaggttcaacagaagatttctgtgcttaatctctcagccattgatttaaaaaatttccatatctgataatcctatcgcagtttatatatctgccttgctaatttgcaaattttggatattcacccctatgtaaaatctccgactcagtttttcagtaattgaataaagttaatcacttttattggccagtttactttactttttgagactaatacatagaaatatcaagatgttttaaattttgttttctcctgttttttcttctatgtatcaacttagtaaatgtcttaatgttcatctctaatctgggggtttacattaaaggatacaactaaaataaaataaccgccagttaattttaacctaaataatttttagtgttctgtgcctttagcttaaccaggactcctggcttggatgcagtggttacatgtaggttctggagttggtctcactcactttatgataattttggccaaggcatttaatttgtgtgtgcctacctactttttctcatctttaaaatggggatagtaagagtgcctacttcatagcattgttgtaaggattaaggattaaatgagacactggaggaacagggcctgtcacataacacatagtcactgaataaacaaaagttaacaaatattgatcatatgtagggacatgtgtctagctaataatgttactctctggccaaccctaaacttagaaaaatccccaaagcttcccttagcctgtttaccctactttggatcttaacttaaagggggcatatcaaatactaggacagtgattctcaacctcagtgacacatgtaaacagcttgggaactttaaaaattctgatgcccaggccatacccctatgaaatcaaattagaatttctcagagggggcacaagcatcatgtttttttttttgttttgttttgttttttttttgaataaacccagatgattcccttgcacagctaaggctgagagccactgccctaggatatttgttggaagtgttgtcattagggttttaaccaaatcactgaaaagttttttaatcaagtccttcagaagagttgcgggataggtccatgctcctcaaacctgaatgtgtaaacccatacctggaggttgcgttgtggtttcatattcactggggctgtggtagggcctgagattctgcttttctagcaagctccaagtgatgcacatggtgcttctgctgcatccaccgactttaggtagaaggggattaggtaaccttactaaagtgctctgagcaagttggaagaaacactgcttttgtcattattgtttaccttgggagaatggattccaggatctgatgttttaaagagactgtaagtatgtttttagccaagcctgtaaatattgaccttctaaggtatctttaattatgaccgactcttggtttgtccttgcagggctcagaagcagctagtaaaggagactttctcttcagcagtgatcacctgattgaaatggccaccaagctctatcgcacaactctcagccaaaccaaacagaagctcaatattgagatttccgatgagtacgttcatgtattgtttgaaaaccctttttctctttcagcttttttgttttagttcagctctcgatctcattcattaatacaactacttattaagtaccaggtatgtgtctagtagttgttccacatgataaatgggcagtgaatgacactgaccaagtctccaacctcatgtacctgacatcctagtggaagagaccagtatgtacaaataaaatgatgaaatagttgataagattttggctaacaagtgtttatggaggaaaaaaagggttaagagtcagagagtaggccaggcgcagtggctcacgcctgtaatcccagcactttgggaggccgaggcaggcgaatcacgaggtcaggagttcgagaccagcctggccaacatggtgaaaccgtctctacttaaaatacaaaaaaaattagctgggcgtggtggcgggcgcatgtaatcccagctactcaagaggctgaggcaggagaatctcttgaacccgggaggcggagattgcaatgagccgagatcgtgccaccgcaatccagcctgggtgacagtgtgagactccgtctcagaaaaaaaaaaagagtcagggaggcctctttgatgtggtgacatctgagactggtataaatttgaaatttgcttcttcaatttctcattagggttctgaatatagaagttagttatttgcatacaggttggggcatccccagatttattgtatctatctatgtaagtgttttggagaaatctgagttactgtgttgattatacttaattggttacctttcaatagattgtttacctgcttatatacttctttgcatgtctagattgctcaggaaattatattcttttctaattaagaattttctagtctattctgtttcaactcttcctaaaagtctttctaaaataaatttacacccatttctgcccctttgtaagtcagactctctttgatatgttaggattttgcagtgctgtgggcttttcttaagttctcattgaagtgtttagatttgggtgggaggttgggcttcatgtatactctatattggaaattgctgttcggactaaataacttttcttgttaatgagatctttctcataaagaaattaggaaaaaaataatggttggtgtgtttcagttaaggatttaacacgttagggcctattagagctttaaaatccctttataatagttgaagtttttcataatctgggagaatgggctttggtggggctgctaattctcactcaccatgggaagatcgtatgtatcccagacagcagaagctcctcagtgtacagacgaagcagtctcatagttgtcccactatgtgaataaactcatctttacacagaaaggaaatcacaccaacatccagaccacaaagtactgctatttttaagcatttcccaaaccgggattctaggaacattgcttgtacaggatgctaataacgatgtactgtgaaaaaattgttctctgatggaaatttaaaatctttcttcactacattacatctcagagtccctgaaatcttgttgtgattctcctgaggagctttgcggggatagcgtgtggcgtgaatcctaaacatagtcaaccacagagctccttcagcagctctcacagcttgtgttcgaaggtgtgccatctgggaaagggggacagttcgcttctgggcagcaagggccctgccctgtcacagagggcgtgtgatgttctggatgccataagctttcagtaaacagttgtctgagcgaagatttataatgtggccacatgaagaaaacaaacattgggtagcattataatgcctttcattctccagtgcctaattattgattggtctcataaaaataaaacagttcataggactctacatagcacccgtgggtcccttccccaggtggcacaggaagcctgcagaggaagtttgtaggtaaggatcgtaaatctccttagggagcattttgaatttaaacgaaaatgtccaaagtcataggcaggggcgcctgttcctttatgtgtcagccctaagtggcttcgctagctctatagaaccagtgttgaaaaccacatgcagtttagtgactaagcccttccttgctttttccttcccagaagtagaagtagttactctaacaaacctagattctgtaatcattatggataagtggatgtcagtttatggaaagagagtcaaagtcctgtttactctttagtggattttttttttttttttttttttttgaggcagagtttcgctcttgttgccaaggctggagtgcagtggcacgatcttggctcaccgcaacctccgcctcccgggttcaagggattattctgcctcagcctcttgagtagctgggattacaggcatgcaccaccacgcctggctaattttgtatttttagtagagatggggtttctccatgttggtcaggctggtctcgaactcctgacctcaggtgatccgcccccctgggcctctgaaagtgctgggattacaggcgtgagccaccgcgcccagcctgttcagtggaatttaaacttgtacatatagaagtgagaattgaattcattcagagattcagctgccttatagtttctagtccttaaacttctaagctgttcaatgtgtaactagattgcattttaaggataacctgcaagatgtgtaatgcagttatgcaccacataatgacattttggtcagcaatggattgcacagatgacggtggtcccctaagattgtaatggagctgaaaaattcttctgtctattgatgtcacaggtgttgtaatgttatagtgcaaggcactactcacatgtttgtgctgctgctggtgtaaacaaacctacttcactgccagttgtctacaagtaaaagcacatacaattatgtacaatatgtaactcttgataataaatgatgttgttactggtttatgtatttattatactatacttttttttttttgagactcagtcttgcactgttgcccaggctggagtgcagtggcgtgatctcggctcactgcaagctccgcctcctgggttcatgccattctcctgcctcagcctcccgagtagctgggactacagctgcccgccaccacgcccggctaattttttgtacttttagtagaggtggggtttcatcgtgttagccaggatggtctcgatctcctgaccttgtgatctgcccgcctcagcctcccaaagtgctgggattataggcgtgagccaccacgcccggcctatactgtactttttatctttattttagcgtgtatgcctacatgttaaaaaagttaatagtaaaacagcctcgggcaggtccttaagggggtatttcagaaggcattgttatcttaggagaagacagccccatgtgtattattacccctgaagactttccagtgggacaagacatggagatagaagacagtgaaattgatgctcctgaccctgtgtaggcctaggctaatatgtttgtatcttagtttttaacaaaaagtttaaaaagtaaaaataaaaaaaattaaaattttaaaaatagagaaaagcttatagaataaggttataaagaaaatatttttgtacagctatacaaagtattgtgttttaagctaagtgttattacaaaagagccaaaaaacagccgggcccagtggctcacgcctgtaatcttggcactttgggaggccaaggctggtggattgcttgagcttaggagttcaataccagcctgggcgacatgacgaaaccccttctcaacaaaaaaattaaaaaattagccagccatggtgacacacacctgtagtcccagcttctcaggaggctgaggtgggagaatcatctgagcccgggaaggtcaaggctgccctgagccatgattgctccagtgaactccagcctgggagacagaccaagaccctgcctcaaaaacaaaacaaaagtgtcaaaaatgtttttaaaattgtaaagtttataaagcaaaaagttacagtaagcaaaggttaatttattattgaagaaagaaaaaattacctataaagtataccgtaatgtaatgtcctaggccttcacattcactaacaactcactcactgactcacccagagctacttccaggcctgcaagccccattcatggtaagggcgctagacaagtacactattttttatcttttatgctattcttactgtaccttttctattcttactaagtttacacatacaaataccattgtgttacagttacctacagtacaataacacgctgtagcatctaggtttgggtaaatgcactcactctatgatgtttgcacaatgacaaaatcacctagtgatgcatttctcagaatgtatcccttttattagatgatgcatgactatatttctaaaatcaagttcccaaatagagtaaaaactaaagtgaatttgtttcattaaacattttaaatatatgtgtgtgtatatacatataggtatacacgtgtgtacaatagatacacatatatcatttaagttatacaattggttttctgaatatttgaaatccaaacaactaatccatgttccttttaccttgaaattctaactggtatgaatgccatgaaataatacattccatgttattgtttgttggaggaggattttctcttttctatgaggtgaagataaataatagtgcttacctcctaggattgtcttaaagcctgatctaataacatagtaaatggccaagcacagtgtggtatgtagcaaatcctcaatatatcttgcctattgttatttctagtgtgaatctttttttttttttttttgagacagagtcttgctctgtcgcctaggctcgagtgcagtggcgagatctcggctcactgcaacctctgcctcctgggttcaagggattctcctgcctcagttccccgagtagctgaggttacaggcatgcaccaccacgccctgctaatttttgtatttttagtaaagacgaggtttcaccgtcttggccaggctggttccaaactcctgacctcaggtgatccgaccacctcagcttcccaaagtgctgggattactgtcatgatccaccgtgcctggcctctagtgtgaatattaatcaggaattatagacatggaaacagttaatgtaggccaaggttattggggaaagaagttcctatacatttattacacttacaagtggtcttttttatttattttgaggcagagtctccctctgtcacccaggtcagagtccggtggtgtgatcccggctcaatgcagcctcctctgcctcctagctgcaaacgattcccctgcctcagcttcccgagtagctggaattacaggcatgcaccaccgtccctggctaatttgtgtatttttagtagagacgtgggtttgccatgttggccaggctggtctcgaactcctggcctcaagttacctgcctgccttggcctcccaaagtgctgggattacaggcatgagccactgtgcccagccacaagtggtctttgaaaataaaaatgtgaaagtgtttgatttttaaaatgtgtgaattttcaataaacctgaaagattttttttgagacacatacatacaagtatatatgccagagatatatctcaggtagttgaatctggaactatagctgtcctttcctcattgctttcaagttgaaaatgaagaacccatttaaaagatcagaagcactatccttataaaacaactgatgaattagaaacacatttgccttgtttcattctagcagataatgtttgcaaaatgtggcctctttagaccttgaaactgaaactaatggatacagagcagagctgtggatcctcacatcgctgggggatgtcagtaagtggtcagtggttgttaggttgactcactttagtaatgtgccattgactgagaaaaccatccctgagaatatggaaaatgtcataatgctatgctaattatgagggtagagagaagagatcactggttttggaactggaagacctggtttctggcccagcgatgcagctctcatgtcccccagtgatgctatcctcagttcagggatctcatcatatacagttgggggttcctcgcagcaccagcacagggatggtgtgaagaaccctctgtggatgctcaattgtacacctaaagtcatctcttatcccagcagtggtccacatgatacactgagggaaaaatacactaatggattttttaatccatgaattaatttctatacactaatggattttttaaatttttataatttttatataaatattttaatgggtattaaagatatatgtggtagatcaaacacatgattttatgcatattctgtaggtcactattattttgaaatacatttaagctagcaatagctattagcatactatgcagataacgacaaaaactatgtaggacatatgtgagtaaccagtgtttagaagccatagactagagggttgccaggccccttccttttgtgaaattctttacctcattttctcaatttgttgataatttaataggagccccctcccatattttttttttgccgtggaaaaatggaaatataacctgttggtctttccatttgaaacacagaaataattcttagcctttctaccttactagaatatgatgagttaatgaactttagttttcttagggctaaatgaggactactggaggtaaattgcattgatacaattctgtgtaagaagtgctcatgggaagaagtgatacaggttgagtctcccttattcgaaatgcttgggacaagaagtgttcccagtttcttgttttggaatacagtcatgtgtcatttaacttggggatgtgtactaagaagtgtgtcactaggtgattttgtgcaaacatcatagagtgtgtacttacacaaacgtagatggtatagcctactacacacataggctgtatattatagtatagccaactgtttatagcatgttactgtactgcatactgtaggcaattgtaacacaatggtaaatagttgtctatctaaacagaaaaagtacagtaaaaatacagtataaaagacaaaaaaatggtacgactgtataggccagctccatcataatcttataggacccccatcgtatatgactgacagtgaattaggtatgtttacatcagtcaccacaaacatgagtagtgtattgccctacattaggagagctatgacgtcactaagccataggaatttttccgcgcttatgggaccaccatcatatatgtggttcattgttcactgaaacgttgttaggtagcccatagactgtacttgcattatacttaatgtttcagtcttaatctgaaatgttccagcaagcatttcctttaagcatcatgtcagtgctttaaacatttcagagtttggaggtttcagattttcggattaggttagggatgcgcagcctgtactcgtcaagatcagtatccattaaaatacaaaagcaagtgttattgtaatcatgagctgttttgtgtatactttaatttgttttattcttttctcctaggttcctggtacagttcagacaggacaaagtatgtgtgaagtttattcagggaaaccagaaaaatgggagtgtcccaacatgtaaacgaaaaaacaaccgtctccttgaagttgctgtcccttaactggcgcctcctctctactttcatggacttgttcctttgtaatagtgcaatttggttttgttttatttggggttcattgtatgtttgggaatcaccaaaggcttttagagttctttggcaaaataaaaatatttgactaatcaatttttattattggaatagttttaacctttcaaatacatgttctgtcctggagcaggattgtagaaactaacagtgtctattttcatgtctgatgtgttcttcctttagtcatcatgttaggtctgtgtaccctaaatcagcatattactcataaatcattaattaatataagcataggaaatggtcttaaaagatactgcattcattcatcagatatttattccatgcctactctatgctaggcactgtgctagatggtatgaaaacttattaggaacctttttgtttttgagaccattgcattctggctggtttgtgctggtttaacgacatctaagaaggtttagaaatggtgagaccaaaacaataactgttaatgatggacagcattattaggaaccctgtagtatgatatttaacaatataggcttcaagaagggctggtcctaagagggggcagaaatgaatgaccaggttaaatccctctacatgtggtttctgtttgaaaaaaagaaaactgacatttgaacaggacttttaatttgtttaaaactctggtaattacttgtaacagtagaaaatagaagtcattcttattttagaaaaagtgacagaagcagtccagtaagattatatgtttctgtttctggtaaataccatatatgatcctcgaaatgataatatctccagaatattgttttcacccaaatttgagtagatattttaaacacctaacaaagtaaagggctaaaagccattcagatagcagtaaaacattctgtatgatgtgcaataaaacatccaagatcttttttgaaagttttatttataatatacatttttgtatgagaaaggtgattggtacagggtgcctattttagtcatggatcaaaatttgtgtaacttgcagggctttctttctttttcttcaaatttacaagggttcattttggaaactacattttaaactttggaatcaaattgtttcttatttgggaggataatgtatatacattggtattatgttaaataataaaattgttctaatttggtgccatttcctgaatcacaactgtatttttgtatctcaagctattttcatatgttgtgtgtcaatgtatcatctctcagaaaggttttacaatccaaacattatatgttctctgtgtaactgaatttcacttatcttttataaaccagaaacattaattgaaaatattttctggggattttctcttgacttgtatttttaaaaattgctcacataaagaagttctcagaagtc

SEQ ID NO: 149 - DNA, 41208 bp, Homo sapiens
gcaaggtatgacagaagagagccagtaatgcccatatctccagctgccagggagtggggcaaatttgccggtgagtttgtctttggccagccacagtgagtagtcccaggtcctccttctccttccagtgacttcctttggagaggaatttcagagatgagcagccactcatgattttgtgtttgtgaggctttggtaatttgaggtttaattaataacatatgtagtgaataagtgaatttatacagtgaataagggaacatgtacagtgaataagaaggaatttattaactttaaggcactttacgtaataagagcacaagtctgtataaaaatatttttgttttcatttattcttctctgttcttctgtgctccactaattttatccaaagatcagaatacaggaaatgggaacctataaataacctttttttctgataatctccaaggtactaggtgtaaatgcagaagttaatgaacatttttatgattattttccctcatcagaccttgtcatgttttatctacaattttggcttattatgaaggcatcactagcctcaaacccttcttgaaactgagtaatatttttgtactttctcaaaaaatcctgcaccaacgactaacctatggcaatgaaaactcttggccttacacattcttcttctcagatgatactttctcaagaggaaggcagactttggggagatttctctgggttcttaagcttgtctccattgtgtcattctttgtattgtggggatgtaactacagttccattgttttttatactattctttaaaatagtgtaattgatgcttcattcctttcttttttctgattctttgtcagtatttgttgaatatgaattttaaaagtttagttttgcttaaaattgtttatcctttgaaatttgacaaaatgtgtttttccctcttaaagtgaacttacagataaaagtgatgcttgaatttctcccacattacttttggtttattacgtttcctctttcaaaattcattcatagtcctatagtttcaaaaaatccacttattggtagctcaaatgcataatttcaaatatatttctgggcaagtggttagccttaaaagactgcaaaacttgtactttatgtccttagagatggtatcctaaaataatatagccacaattctgttctaataatatttgcataatatagagttacaacatcattgtcttttttgaaaaatgaatagaaacttgtgaacagaaatcagacctcttattcacagataatgagatcaggggattcagttaccaggcctggtaaccggttgctctttctaaaattggacatgggaggacagcacaggggttgtcagtggaagtcacctgccctgggttcaggcattaacggggtgcagttcctatagagaataatatttctaaacatgtctaaaagataatagaaccaactgaaaatcagtcttctttatcatcagcatgttctggtaattctaacccatgtcagtgacatgggttggtgatatgggcagaccaggcccacagccaccttcccctccttgttactgctgttgtgtgtgtgagatttgatttaattcactagtgggaaacagtctacctcaggagacagtggctacttccaaaaaaccatagtttagcaatgatctatcagtcccattatcttgggaattgatggcttccgggtttgttatttttatatatttcttttaacataacagccatctctcaggctagtaaaacccctgattttatttttatttagggacgaggctatagaacctactgcttctgcctattattcctgaatcttttgactgcaatgaacaactcctgagtcttttgactgcaatgaacaactccttagctaaagccccaaaagtgattttattttagtaatactcggagatctcatagaacacagggcatgagacacaggggtctgaatggcctcaggactctctttatgatctttgcccctcttggtgcatctgcttccttttgctctgtccttctttctacagttaggtcgttctcaatcacatattaatatcacctagggttttttctcagttctgtatatgaatatcatctgtggaatttaaaagaccatttatcctaaatgttaacagcacaatgtaggtgaagggatattaagtgttcactgttctattctttccatttttcagtcgtaattaaattattcaagataaaaagtttggggcaatgtattagtgtctgagcctcagccccagaaattctgatttaaatggttctgaagtggggcccaggcactagtatattttaaaagctcctctgggaatcccgatgtacgattgaagctggaaatcactgctatggattgctgggtttttcagcttctcttgacaaagagagtgagtcccatctctttcttcttgtccaaatttcaaaattcctggggtgaggatggatgggttcagttggatcaactgccatcccctaatgcagtcagctctgaccaagtacactgttcagctggctgcacacacaggaaatgtggatgggtaagcagtttccagacagggatgggtgggctgagggggtagttaggaaaataaatgtaataatgataataggagtccagtgtattcctctaacagaaatgcaaagtgagtcctgaactgctgaatttgagaacatccagctgttgataagacaaagccattgcttattatgaccgctgttttttcaaattatatctatttcaaaagaatggaataacagagaattggtctttgttaatctgaaagttttggatcgcaaaatacaaattaacatgtttgataacaaaaacaaaaatcttatccatattagagtaggaagttgtaaaagttgctctgcattaggtgatgcatattagcaaatactatgaaggtcactgcttggcataatgttctatttgtagcaggtatacattttatctcataacacatctggcttttaaaatatcacatttcctcaaagattctaaatcagttataaatcagttaatagaacgagtcctccctactgccctttgatttcctacaaatatttttgaggaaattccatcttggcgttgtgtttggagaggctgtcttctgccaaggatctaggaagaatttggagagtctaaagcagtctcaagtcatcattgcagctggaagagagtggcactatcccttctgtgcaagcttgggcacggagacattttatgatggtctttaatgccttgggtctcaaaggcatttgagttccatatatattcagttctcttcacacgctgagtcacccatgaatgtcttctcacttctacaggcattccgtggtacgggagctgatacctagggagtttatataacctcttccctttctcaaaccaggaggaaaactcttcttccttgcccgaaatacctatcttttttctagtaattggaacacctcttaagccaggtgtttgtacaagaacaaaagcctgggtgggaattgagttctgggtacttggcaatttctttggttgtgtatcacaaaaacctgtgataaccctttgaggtagagagctcagaactttaaaaaatgttcagaaaatatacctcttcactggcccattcttctatagcaatgacacacacacacacacacacacacacacacacacacacacacacacacccaattttaagagattatccagatactgatatctgtgcccagggccatttcctgaggactgtgaatcgtgtgctttggtggggtggaactgctaagggaagacaggagaaacataatgctgatgccaaatgcctaagtcgtgacatgttttcagccggttccgaaaagagaactgggcttcctgtagcaagaactgggctttgggagatgaaaaggttctgtgagttctgaagcaatcagagcaaagagagagagaaggaagagcacagaatgagggacgggcagtttcccatatccctgagaagtggtggagaccagacctgacccaggcagatagtctttggccactgagaaaacaaagaatccatgtgatctatgtggagctggctaccagagaggagagtgggacacggctatttcagtgtgggcgaagcagggctgagtactgatgcccaaaagccagcaatgattgtacctcttgtcagaagctaccactgtggaggcttcatccatggatgtctttctcatgataccagaatattatcccaggagaaaaaggaagaggaaaagaaggaggaaattctgaattgatcagaagagatctagtttaaactgaaagtcaatgtgttaccttgcatgggttataatgcaaaaaaaaaaaaaagaataaataaaacaaaaacaaaaacatttgcattcatgtttcgctagtttcatggccgctagacgcagtcacaatctgtgtgtacttgtcataagtttagactttaagtaaggattcttagttggtttattcagatggccatgacttcctccaaaatgctggctgtgcctctgaaatgctctctttttcctgagcctctgtgtctcagttctccttcattgctgtccttctgggatctcatgctggaaaaaccatttcaaaacttctttggtgcaaaactttcttcctgctcaagaaacaaattgtaaacaagtcaccctttgaatagaaacactgataccttgaccatttattcatttgtttagctatccagaatgagagtaaaatacggtattttcagacataccaagattaagagaattctcaaccacagatgttcatttaaaaagtttgaaaagatatattctagcaagaagtaaagcaaatacagagaaaacagatgtaatactagaaagaatgtgaaaagtaaggaaacaaagtaggaaatgtggctccaatatggagaactggtggttttaggggttagatagccccttgttttcatattgctttttacttttgaacatccatttggggacacttttatctcttcatttatgaagtaattaatcacaaataattattcatagtgctcctatatctactgaaagagagagagagagagcaacccaaacatgggctggagctaaagttcacaaataatctgaaactccaaattgtaaaataattttaaaagatgactggttgggtgagtatgcatattttagtgtaattatttaagccattgaggcaagaggtccacatatttagtgcctctacagccatgtgatcagagtagagatgctacctaaaatttctcacttcaatatcctgattttgtcaaaaagaaaatagttattactcgtcagtgagcacagttatgatagtttatactatgtaaacattcaaatgtaaagtttttagagccattgataggtcaggaatcattcttttgagatgaactgttataagctctccataacaactattatacatacaactgttatacataccaatatatacgaatatatatttgcacatatttttagaactattacgtatttatgttgggctttctcatttctgagtcctcactcatgtgaatgacgtagtgctgggtgtttttgcagaagtaggaggcatcatggagtaacgtgtcctacagttgcaatagcgacatggtttttatagaaaaaacaagatgaaggctactgaaatctgaacaatagtagaagtgcttcaggaaaatatttgcataatgaaaatacacaaatctaaaaacaaatatttcaggctaaatgctacctaaatatcagcttaactcccttatttctctttgtttccagacttgctcctccttctctatttcatcttctcattaacggcctcaaaacagtttactcgaaaaacatcaatgtcatctctttttgctacccttttcatatatgcgtttcccctcaaaattactgtctttttctccaaagttaataacagcctctgctcttcactcctctctctttctcattcgggcatcggattccatcatttttcttctttgaatccatctccctgatattgcctcggtttgggtccttgttactgttcatctggactaaggaatgtcttcttcgctgacgtcccggttctggcctctgccttctgacttacccactgcactgttggcaaaataatctttctaaaatgaaatctgattctgtcattaaaatgtttctgctggattacctcaaatcttcactttatattgatactttgcttctatttgatgtctctttcttcaagctcctaattacttatgaatttcatgatagtattttgatttttcaagagttatcttgatctgttattttatcttttcttctttgaactcatgtaataaaaaaatgctcatattatcttgttctgtatcttaaactaactgtgaagaatttccctgcaaatgtgtatgcgtatgtgcatgtgtgtgatattaacttttatggtgggttttttgacttaagctctgctgctttgtttttctccaaaacacttctctataatgtgttagcattgttgggatgcatctccttttatattgttcgtgcttaaattactctgatacacagaaggtgacttcttttttttttttttttttttttttgagacggagtctcgctctgtcgcccaggctggagtgcagtggcgcgatctaggctcactgcaaactctgcctccaaggttcaagcaattcttctgcctcagcctcctgaatagctgggactacgggcgcccgccatcacgcccggctaattttttgtatctttttttttagtagagacggggtttcaccgtgttagccaggatggtctcgatctcctgacctcgtgatctgcgcacctcggcctcccaaagtgctgggattacagatatgaaccatcgcgcccggcccagaagatgacttcttgactcctctctctccgtatctgacactacttcattctttaccagggtaaggtttgaggtctgggcattttgtgctctatctccttttctgcagtgtaaggggagagcaggaggaagaggctctctgcagcagcactgacacctggtatattgggcaagctcccaggaacaaatagcattctccatagggttttcctgaagaagatttagctgaaaataagaaactgaagagaagttaatgaagagttgttttttttttttttttttttttacagaggtatttttttttttttacagaggaattttttttttttttttttttttttttacaggaagggctaaaggactcaacaaggcaaacaacagggagccgcaggagtggaaagccatcatgattcgtaggcctgaggaggcgggaggtcagaggagggaattactagagccaggtgccaactgaggcttaagagagaatgcctaacaggaactgcagtcagagaaaagcagccgctgctaggaatgtgaccgtgcagggagagaaaatgaatacatctcctcatctctctatcctcccaccgtctcatctcctgccaatgactcccattggaataagccaatcggaagccagagtcaagacaatctgccgaggctagcttcctggggcagagagtaggatgtggaagaacagagaataactccaatgggtgatgggggacaaatggagggcaacccacccacctaggcttagctctctgatactgcgattttgttaaatgcatggtatcaggacttactccattttcgtgggttatatatgccagtggcagatgtcttaaggttctgagttgtttctttgactctaggtatggcccaggagtcttcatttctaccagaaagaggcagtttcactgttccctctccccatttcacaatgtatccctaacatccaattttaaaatcctcagctagatgaggaaaaacaaaataattgctgtattttgcctctttctagatttctaagtattagtgacatttctaaagattttgtctactctatagtttggttaaagggaacagaaaaggagaataaactttaggatctgtgctctgctgctacactctactccatttcaggatttctgatttcttttctttaatagttttggattgccccttttctcattttgttacaactaaagtaatttcaatattttgttagatgctgaaaatgttctttaattcattaccaggttggtgagaaatcccaccagtgtttttctatggatgagcatctgatagactgcttttcttattaatattataaaataatattatataatataataaaataatgtatgatataatactatctcatactaatattatcaaagcacttcataatggtttttaatgtttgcataatattcctttatatagatttataagtttattatctactatattattgtttgacatctatactttccatattcttttttttgctactctgtatacaactgccatgagcagccttgtacgctttgcctttttctgtgcttccagttatttctgtatgacacagttctagtagtgctgcaagtgccgtaaaagtttggctttacctggttatttagagttcctcacccagttctgtatattttcctagtttctttatcctggcagcctctgacagtcagatgaaattctctctttggctttttggtgagtcacaacgtggatgagtctcaggcacaccttcaccaggtgcctgacacagctgccgtctgcacatgctcatccctatttactgtttacatttcagatgtgagtcatcatctattacctggcatcaattgaaacctgcatgcataaaggggaaagtgtccaatgcagaagctttagagaaactggccaatcctcagaggaaccaatgaacatgaaaaagtttttctattttttttttattgttattattattattttttttcatacagggtctcactctgtctcccaggctggagtgtagtggcacaatcttggctcactgaaacttccgcttcctgagctcaactgatcctccagcctcagccacctgaatagctgggattgcagcatgaaccaccatgcctggctattttttgtatttttcatagagacagggttttgccatgttgtccaggctaatctcgatgttgtccaggctgatcttgaactcctgagctcaaagtgatctacccacccccaccttccaaagttctgggattacaggcatgagccactgcacccagccaatttacagtttaaaaaactgggattctggggaaaactgagggcttccccaaacatatgagtaggtagctctgtgagtatggtttggaatatagagagtcagcctggttgtcaaaaatttggtctactgacctgaggtagtgcctatacttcctactgctggagaggctgcctctagataatctcttttaaaatgtgcacttgggataatgaaaaccacaacatcattaatcttctccttcctccttccttctttcttcctcctcttcctcctcctcctcttcctcctcctcttcctcctcctcctcttcctcctcctccttccctcctcctcctattcctcctcttcttcttcttcttgctagagatgatgaccagcactttgcatgtccaatgaggacagacaggagtacctggaaagtatgatagagttcaaagagccttggtcagaagtcaaaagagaacctggttcttccagtaacttgaggtgtgaccttgagaaaaccacttaacatctgaaccacaatttcttctttcataaaagaggaaaaactatactttctatacctacctcacaaaactattatgatgtcaagatgaaagttacacaagcataaccaattttactgcactttgctttattgctattcatagatattgcattatttttatttttatttttttactaattaaaggtttgtggcaaccttgcattaagcatgtctactggtgtcatttttccaacagcatgggctcacttagtgtctctgtgtcacatttaggtaattctcatatttcaaactttttcatattatgtctgttatggtgatttgtgaatagtgatcttttatgttactattataattgttttggggtgccacaaacacccatattagctgatgaacttaagatcgtgtgtattctccaccgaccagctatctctcaccctatcctgaggcctccctattcccctgggacacaacaatattgaaattaggccaactaataacaatcccaccagttggctgggtccaagtaggagaaacgcaatctcaattttgggctgtgtcaagaaataaaagtcacgatcccacctgatgccttcctataggctcgagagacataatgctttctgtgacccttgtctatgtatgagattcacagtcttacctgttgattgggtccagatatcagagtcaacatctctcctgttggctgggtccaggtataggaataacaatctcacatttgggctcggcccagaaatgagaatcacaatccctcctgtgggatgggtattcctatgggaacacttctaagtgtgcaaatgaaaggaagtgtcgcttgtccttcactttaaatcaaaagctagaaaggattaagcttaatgaggaagacatatcgaaagctgagataggctgaaagctggacctcttgagccaaatagttagccaacttgtaaatgctaagaaaatattcttggaggaaattgaaagtgctactctagtgaacacatgaatgataagaatgaaaaacagacttactgctatggagaaagtttgaaaggtctagatagaagatcaaatcagccacaacattcccttaaaccaaagcctaatccagagcaaggctcaactctcttcaattctgtgaagtctgagagatgtgaggaatctgcaaaagagaaatttgaagctagcagaggttggttcacgaggtttaaggaaagaatcatttccatacataaaaatgcaaggtaaagcagcaagtgctgatagagaagctgcagccagttaaccagaagatctggctaagatcacagatgaaggtggctgcaccaaacaatggatttttaatggagacaaaagagcctcctgctggaagatgacatcttggactttcatagctagagagaattcagtgactggtttcaaaacttcaaaggacaggctgactctcttgttgggggctaatgcagtttataactttgcatagaagccaatgctcatttagcattctgaaaatcctagggcccttaagaattatgttaaatctgcagtgcttgtgctctataattatatggaataacaaaacctggatgatagcacatctgtttatagcatggtttattgaatatttaagtccactgttgagatcttctgctcagacgaaaagattcctttcaaaatattacagctcatagcaatgagcaattcatctggtcactcatagagctctgatgaagatgtacaaggagattaatgttacttttgtgcctgctaacataacatgcattctgtagcccagggattaaggagtcattttgactttaaagccttattattcaagaaatgcattttgtaaggctatagctgccatagatagtgactccgatggatctaggcaaagtaaattgaaaaccttctggaaaggatttgtcattgtattgtattgtattgtattgtatttttgagatggagttttgctcttgtcgcccaggctgggtgcagtggcgcaatctgcctcccaggctcaagtgattttcctgccttagccttccaagtacctgggattacaggcacccacaaccacacccggctaattttttttttcccaggagagacagggtttcaccatgtcggccaggctgatctcaaactcctgacctctggtgatctgcccgctcggcctcccaaagtgctgggattacaggcatgagccactgcacccggcagatttgtcattttagatgccattaagaacattcatgattcatgggagaaggtcaaaatatcaacagtaactggaatttgaaataagttgattccgaccctcatgaatgactttgagggtttaagacttcagtggagggagtaacatggtaaatgtggtgaaaacagcaagaaaactagaattagaagtgaagcctgaagatgtgactgaattgctgtgatctcatgaaaaaactttaatggatgagaagttgcatcttatggatcagaaaaggaagcagtttcttgaggtagaatctactcctggtgaagatgccataaacattgctgaaatgacaacaaaggatttagaatattattagttaataaagcaccaggagggtttgagaggactgactccaattttaaaagaagttctactgctatcaaacaacataacgtgctacagagaaatctttcatgaaaagaagagtcaatcaatgtggcaaacttcactgtggtcatattttaagaaattgctttagccgccccagtcttcagcaatcgtcactctgatcagttagcagccatcaacattgaggcaagactttccaccaggacaatgtttaggacttgctgaaggctcagataattgttaacatttttagcaagaaaatatttttaatgaaggtatgtacattttttagacataatgctattattgcacacttaatagacaacagtatagtgtactcgcaacttttacatgcactagggaaccaaaaaattcttttgacttgctttattgcaatcttatattattacggtggtctggaactgaatttacaatatctcctaggtatgccagtatgtgaaaatgctctgaaaaaattaaaccccattcgaagatcagctctttcaccaagattgcgccactgcactccagcctgggtgacagagcaaaactcagcctcaaaacaaacaaacaaacaaacaaacaaacaaaccaaagatgagctctttcttattttggaaaagccacatgacatacttaaaaaaaagttacagacctgggttcaaatcctaaagagtaaacagacaataactgtttgcttcattattcttttcccttccataatgtctgtattcaggcaggagggatggattggtcattaactaaagggaaagcagtgggatggttaatgacagatgctgtgtaatcttccatccctgagatcatctgaagtgtatgcctacagtctgtctgggaacttctacagcactttgtgaaatctcacttgaagtctcagtaattcattacaaagcctaattatgcaagtagcagccgcagactgtcagctgaccaagctggtgattgaaatccttctggttggctgataaagttctgtctggagttttgtttaccttttggattactgtgatttgtgatttctagttcaatactttttttttcttaagtcagagaagaggttttaaatttttttttcaaaattgtcttataaaactgcttgtctccatttctgtgtgtgtgtgtttcacacacttgctgtgtgtgtgtgtgtttcagtcaagcaatttttttttctttctaaaggagccaaacaccgaacatgtcccagcctgcagctcacatgttttccttttgcctgttttgtcttaacgttagggagctgggcctgtggtcagtcaactgtatggcttttaggtgcagacattctatacagaaacaggaagagatactctgaaattaaattgctaacaaagatgagactcattttgtggaatctggaattttggaatgcttcctgtcatgttgattcgacaggctttgattcttagagtcttacagtctctagggagaaagccccagtccaagttcccagccaccccgggtgtgcatcagatctctcatactgtgaattcccagagttgtgaggggccgccaaaaagatgccatccttgttctagctgctaggacattgctgagacataaggagctcattttttgtttgttgaacaaacacatggattaacatcttaagtaccttctctaggtctggaaagcagagaatgggttggagggttggaaatgttattcctttgtagatccaaacattctactagtatactttgctgttcccttttttgtccccctccccagcccccgctttttttttttttttaaataagggagagggaaaatagtttcttaatttttactttaaaaaaattctaatgcttttgtatttggcacatttcaccttaggaaattgcaatattaatgaaattgctttatttattttaatatgaatcacacgaagtgacttatttttaggttgtatgttcttgacaggtaagccttttctgaaataaatgtctataatgaattttttagcttaggacatgtgaaaccaacatttcaaacatttgtttgagaggcaagagttatactccagttacccctgctgacccgggggagggaagtcagaaccaccagacccctgtggcttttcacaagaaaatgaggacagaggatctggcagataggaggtgggtggtcaaaagattagagtcacactactgttttgccactacacgcttttgcttcttttaaactttctgcttcatggaactagaaaaaaagctaatgactatggtttaatgtcaacaactctgaaagaaaaataatttcattcaaacccagattaaaacacaccacttaatgtaaagagcaatcagttttatcggctaagttttttaaaaggtcaactttaagaaatatttctttcagttaaaataaattagataaaggtaaaaaatatgctgaaaattaaaatcacactgttgctgaaatgtggaaaaagacagcatgtcagagttgtggtcctcagttattttatttcaaggtagacttgggaagtaaagaaaatgttcaaaacttctgggctctgtgcagcaacataactatcaaaaaaggccatactactgcaaagtacaatgaaggtcacttccacagagatcacaaagccctcatttggacataacagaaatgtaattttagtaataatcaaaagcatttttgataaaaattataacaactgtatttaaaatgcaaagcaaaatgacaatttaataaacagattttcaacatattacattaaaattttaagcaaacagaatgagtttcatcctgatttgcagaactcagctgatcatacaccttctttttaaaaagatctacttgagcttctgtgctgagtaatgctgacattatgacagtttgttgtcttgtgtcatcccctaaatcattttttagaattagttttagttaagaaaaagaacattctgtatgatgagaattttgaaagataaaatcaacttgattcagaaaaacgtggagtcatctttaggtttcatgagcattatgtcatcaaattcatcaatggctttaattttttctaattttgattattttgcccaaagcagtaattgcattggtgatgattctgataggtcagtttgatgatttttataccataattttcatctgtttgattaacttaggtaggaataaaggatgaaaatatggctggcaattttacttgaaattgtgtgtccatctgtgttgctacaaaatacatgtaaagtgatgattaacaaagtagcctctttgtgtgagaagtacaaatgtttggacagctgtattaataataggctgagataggcaatacaaaatattttaaataatcattgaatttcagtggaattttagctaggcaagtatttcaatggaggaaacgtgactggaaaatgaattttgcctagtctttaaaataatgacattgtttcctatggaattatgcatgattgggctagagttcttcttggctaaaaatggtcaaataccaaatataaaccattgtgattgcttctggtctttgttgatgacattcaagtcttctgaatccttttatctaaaagtgaagagacagcaaatagctttcaagaatgatctcaactcaagataaaaaatattaacattattaaagtgtaatattaaatttcttagcttaggtgagtcctctacagagcacagaccttgatgcaaattatgagctcttcccacccacctcccctccatctttcctccctactttcctctttctttactgaatatactgtgtgccaaccatgtatcaagcactgttctaggtgtcaaggaatcagtttagttttgatatcagttctggtagaaataacaataacagaccatgctcaagatcagttttgaagaaatcacagattacctatgaacatatagttccagagttaggtgggagtgaggaataataggccaagcctcttcaaaagatatttctaggctgagtttgcccataggaaccccagctcatcttctactgtagccattcacagatttctcagccctgcctaacccagagactgaatcatcattcctgctccctgaatataggctgttatttattatatccatgcaggcaaggtgaaatctggcaggcagtagcttcctttggaggggttctcatgttaggagtgacgtgcaagccaacagcagagggtgggggatatctcagcaattgcctgtgtctcccaatgctgcctgtgctgtcactgcagcctcctagagaacgaagtcaatgggaggccacaggacactgcctctggagcagaaaggtctgagtagacagcacggaagaggaagacagcccagtctcataggtgaactgactgggtctgcagtggcatgggacctatgaaagcttcaaattggagacattttgcctttttatttctttttatagaaacaagaaagtcagctgtgtggaagacaatgactcatatacttttgctgtactacttggtgtttcttttgcccacagagtcctgtaggacattgtatcaggtaagaaaaggggaaggagtggaggatgaactggtggggaaagcaaattggcaataaaatccatcagctaaccagctttgggttaccagagagctgaagtatagggaaaagatggtgatagagtgactggcccagccagaagtaattgcaactacagctaaacaaaacccactttaaccaatagctacacattgcttttctctcaacttttttccatgagttcctgagatgcaatgaggctcaagtgatttaagagtaataaatactttgttctatatcttctgatagtgaatgtttcagttgctcataaccagggtggtaccatttcctgggggcacttgaaaatgtggaggtgttaagggttgccataatgaccaggaggtattagtggcatttagaggcagggcctaggaatggcctggcacaatgaagcattgtcccatccaaaatggcaacagcatctcccataagaaacctgatagtgaacaccatgaatgggctagaagaagcaatgagcaactcaggcagtggttaaacaaggtctcactgggacggagtttctggcaatggactcttttaaattttgtaggacggaggccctatggctctttctgaaatatttttcctgacaccataagtcattttaatttccctgttagttactcatttaaaataagttgtagaggagcacagagagaggatacatgaaaacattttgagcatcttctgaagagagtactattatttgaccacaagttctggaaggcagctttgagatcaactggtgaagctccactcccttattttgcggttagggagatggagacccatggtgtgggatgtgatttgcttgaggtacgtacttactcagttacagggccaaggccagaacctctgttttcagattctcggcttcttgatctttccattttaatatatgtcttcttaacaaaagcctcttaggaaaaaaatgactttggaagttccttccaagagtttttcaaatgatatttactttatcctcaagttagtttgtctttgcatgggaatcttctccatggctccccttccccactaatactaaacaggtacctggtttccgggagaagttagagactcttggaaagaccatttcctgaaggctgtccaaccctacagcttgttactatttcctcccttcattccatttccgcattcacacttttctgcaagacagaatgtggacagtaggcagagcatgggaggttggctttgtttctcttgatcattgggatttaccttactgggaacattctatccttctcttctcattagacaagctgctgggtgctgagctgctgagttgctgatgctgctggctcctgacctgcctatgctcccaggcagctcagcaggttgagcaggttgccggtttgcaagtatctttttttcacagtattaggttggggactgttggtatccaaagctaaagtgatctatactggatgctacactagaaatgaaataaccaaaggagtatgcgatgtgctttggcaaacttagatgggaagaaattaatcaggtcctttccttaagaagcccaagttttcagaactccaagtaaacagaatatcatggctttctgcccacatacatgataaatataatgtgacttcacttggatgtgtttaatggaccaagtatcatccagagttgttgacttataactgcatttatcacaatgtattgaagaacatggtcttatcgagatgggttttgagtatcttgagatgcctatgtttccttccactcgtcccctctgcctattgcacttgaacataggccggctgtttagaaaaggcagtattgtaggaatcaggagatctaagttctcgtcctagctgtaaggggcatttcctacatggccttgtgcaaatcaccacaacatcaagcctcattttccttaactgtaaaataagagggctggattggatgatatataaagtcttccaaaattctgaagatattattttagcgttcttgtttggtgcaagaactttaattcttccacgtataagataaggcttgattctctggactataaaatgagaagtcatcttctgtcagtgatttctcatgtatgaatcctcagtgatactttcttgactttggagagatcccaaaagctcaattcagattccccataagttcttatttggtagagaaaagagggaatattcagccttgtttcttgataacatagagagaagtaaggttgtgaagaagaaccccatgagttggcatgaaccccaagagttagtcacagagctatgttagtgaatttccaatttcttcctcaatggattagaacttggaactcaagttggagtaattgggttaaggctcttctcagccactaggaaacactattccagtgcagaagcaagaaaaccgtctttttgtcgctcctcacacacacatacacacatgaacatatatgtcagtatatatatgcatactaaaatgtatatatgcatacacacatatgtacaagacactgaactagctacttggaggaatatactggagcacaatacacagtccatgttcttaaggaacttgtaatttaattgaggagctaatatgcttctacaaaaaagattagatagcaaaatggcaggtcaggtgagaacatgccaagcattgaatgtgtgtttggctgtatggatgatgattcctataggagccagaagaaaagatgtatcatgtgcagaactggatcaggaaagacctcttggaagggggaaacttgagctttgtatgtaactgaaattcagtaagtttatgtgcagagtaataacagtagtaaattcttaaatagacttacagtattcttagagcccattcctagtgcttttcatagaagagctcgtctattcctcataaacatgctctagggcaagaatcatacaattatagtactatagttcttactctactttatggaagaggaaactgaagctcagagggatcaactttcccaaggtctcaaatgttggtgttgagatttgaacccaggttgtctactcccagagtacatcccttgaccactatgtgacactttcttagtgaaaggtcgggtatggtctcgatggatgggacaaagagggggttctaattaggagtgatggagatgctcacggtatgggggagctaggttttggaggagtcctcctaaggaaaaagaatgcaatgttacaaatacaaaactaaggggaaagtgaacatttatttagaatgagaaaaggaatcacaacaaatttagaaatgctggatagtattgtttagcattgtttagtaataaaacaatatttttattaatgaaatgcccaccttttagttcttacatttttgactgcatacttgcatgatcttataatttttttctatagagagaatagaaatattattcagtctttcctgcagcattattgatcaaattttttttcttgttattgctagtttagagaagtatctttgagtttctaatttattattagtaatggcatgtaaacatgtaggactgttatcaaatttgggaaaattctatccaatttatttcaaatgtgagctgcaagatatcaggcaacttagaattttcttgttctgtgaataattgtaaatgttcttagcattgatgtcacttaagtgttgatgttctcactgtaatgcagaagtgactggaaactacataagtatatccgactaaattcaaactaaatgtatcccagcttaacttgtccagaatccatgaatagatacggcttctctggtgatacccaaaatgagggagagtatgaaggaggcagaacactgaaatggcaaaaaatgatgatcttaacagatggcaggtagttaaaacattttgcttttgagaatttaataaaacatatgatcatgtgaacacatgagatgatctgctcattgagcatgaggggagagcaatctgctcattgctagaccctctcccagggcttcaaaatgtcccatacgagcaagggactctgaggcttaacctttgtcaacttcctggtcaatccacttctgctcataatgtgtttcctggatagaacatagacttttcttactggagagagaggagtgctcatactgagtagcagtgggagaggaatgtggtccaggctgaagggaaaatggggtcacagaggagccataattcatggactcggctttgggtgggccatgctggtatcatagctaatttaactgtggttgtttgtgactaaagtgagccattgggctggcatatcaacaattgattttgatgcgagttttgattttccctttctaggctgcaagcaaaagcaaggagaaggtgcctgccaggccacacggtatgttggcagcagttacttatcacatggaagttttgctgtccatctattgtaatagagggccattctcagccttctgtcctgtggcatggcagatggaatccttgatgactctgatttttttccttcatattaaattgtacctttgtggtttttttctttttgacttttatgtttgggggtacatgtgcaggtttcttacattggcaaattgtgtatcactgggatgtggtgtacaaatgatcccgcccaggtagtgagcatagtaccaggtagtaaattgtacgtttcaccccagccctgttcctctctcctcccagcaccctctgctccatctttgtctaagaattctttgccatagatcctttggattgagcccattcaaactgggccagtggctagaacaggtctgtgagaactcattgatgatgtaacatattatagagttcctgagctgagaggcttcttagcaaacattggaagcagtggattccaactagtggactgcactgtgggttcgttcctctcacttcacctgggacagtccttttttgtttgtttgtttgttttttagacagagtctcactctgtctcccaggctggagtgcagtggcacaatattggctcattgcaacctccacctcctgggttcaagcgattctcctgctttagcctcctgagtagctgggattacatgcacgtgccactacacccagctaatattttgtatttttagtagacatggggtttcaccatgtggccaggctggtctcgaactcctgacctcgtgatccgcccacctcggcctcccaaagtgctgggattacaggcatgagccaccgcacctggccgtgttccacttttatctattttacacactacagttcaggataagattttgttggaaacaataaaattttgttgctgaaatagatgatgaccactgatccatttcagtcttcctccactttaggaaaagaagacactgatgtctgcaggatttatgtgctgtcactgcagtgacaccttggtgattggcccagtgggcccagagcccagaccttcccatctgatatggtctcctttcattttcccaggtgtatgcgatggtgtctgtacagactactcccagtgtactcaaccttgccctccagacactcagggaaatatggggttttcatgcaggcaaaagacatggcacaagatcactgacacctgccagactcttaatgccctcaacatctttgaggtaatatcttttcttttgcaatatagattctaatgtggactctatgagcacagtggagcctcccattggcagtggatattgccctcagtaagaaagaggacgaccatgtagcagggcagcatgtagggatgggcgaatagataagcacccactagcctcactttctatgcaaaaatagccttctaaactttgggtatctgaaagtctgtgcccatggacacctggccatgtgaaggggcaggctgcaggagggccagaagggagtcctctaaagcaagggtcagcaaacttctggaaagtgacagagagaaatatttcaggctttgtgggtcacatggtctctgtcatgcctactcaactctgccattgtagcatgaaatcagctgtagacagtatttaaatgaatgggcgggctgcattccagtaaaaccttatttacaaaaaccaggcagccagcctgggtctgtagtttgccacccctgccgtaaagtgtaggaaccagagtctgaatctatgggagatactttctattgctattttcaatcttggtgttccagttgattcatccaactcgagtttcaaatttctatttttaagacagactcatggctcatgatttgcccttcataaatattacaaataagcttaaatgccactagaaatttctatatatacaggttatctgaagagatatgctgaagataacagttgttattcggagagaggggagttaaggaataggtagatgggaaggagggacttttatttgctggttcatacaacttggtattggtcaagttatttcacagcagatgtgactctgagagtgtaaaatagaaaaacattatgttaggctgtcctaagttttagtaaaggtacttttacatttaacacaaaaataaaatataaaaatttctttctttttctatattgtaggaggattcacgtttggttcagccatttgaagacaatataaaaataagtgtatatactggaaagtctgagaccataacagatatgttgctacaaaagtgtcccacagatctgtcttgtgtaattagaaacattcagcagtctccctggataccaggaaacattgccgtaattgtgcagctcttacacaacatatcaacagcaatatggacaggtgttgatgaggcaaagatgcaggtgagtgtccctgaatagttggtagagcattatctcagtgggaaaggaatgcaggtttgttggagtattctgtgagcttcttagggactaggaaccatgtctttcacatcagtatttctaatgtttagcaaagcaagtgttcagtaaatcttcattaaagaaaggatgaataagtgaatggaaaaagtaaacatttaatcaacaaatatttatagagagcacttacttggtactgtattgaactttggagtatgagttaccgatgtatcttttggctactgaatacatttaagaaacattctatgttctggagagagaaagactcttcttattttcatttgtgagtcaggataggttgctaaaatggaaaataattgaaggcaaagaaaacagccatacctatccactgcagaagcatgaaatagaacggggtccattttgcttggttttaatcttcaaagcaaagatagtaaaaagtagattcagactccagggtgaatttccaatttattatgttcttgtatagggccctgcaacacatttgggatgcaacagaggttaatcacgtgataggttctctgagcagggtaagcaagttgctagtttcgactaggtgtgatatggaggggatgatggacatgagcatgtggaaagctgcccagtggcctggctcgcaggaggccattgcataaatggagaagggcatggtgaggcaattcctttgtagctctatcatctaagtcaaacttcagtgtacatgcaagtcacctgagtatcttattaagatgcagattctgattcattaagtctggggtggggcctgagattctatattgctaagaagttcccagagtatgcctaggttgctgattggagaagcacgctttataaaggtgagtgttgaatgtgctggcagtttcagagagtggctcagtactaacactggttcttcattggcagagttacagcaccatagccaaccacattcttaacagcaaaagcatctccaactggactttcattcctgacagaaacagcagctatatcctgctacattcagtcaactcctttgcaagaaggctattcatagataaacatcctgttgacatatcagatgtcttcattcatactatgggcaccaccatatctggagataacattggaaaaaatttcactttttctatgagaattaatgataccagcaatgaagtcactgggagagtgttgatcagcagagatgaacttcggaaggtgccttccccttctcaggtcatcagcattgcatttccaactattggggctattttggaagccagtcttttggaaaatgttactgtaaatgggcttgtcctgtctgccattttgcccaaggaacttaaaagaatctcactgatttttgaaaagatcagcaagtcagaggagaggaggacacagtgtgttggctggcactctgtggagaacagatgggaccagcaggcctgcaaaatgattcaagaaaactcccagcaagctgtttgcaaatgtaggccaagcaaattgtttacctctttctcaattcttatgtcacctcacatcttagagagtctgattctgacttacatcacatatgtaggcctgggcatttctatttgcagcctgatcctttgcttgtccattgaggtcctagtctggagccaagtgacaaagacagagatcacctatttacgccatgtgtgcattgttaacattgcagccactttgctgatggcagatgtgtggttcattgtggcttcctttcttagtggcccaataacacaccacaagggatgtgtggcagccacattttttgttcatttcttttacctttctgtatttttctggatgcttgccaaggcactccttatcctctatggaatcatgattgttttccataccttgcccaagtcagtcctggtggcatctctgttttcagtgggctatggatgccctttggccattgctgccatcactgttgctgccactgaacctggcaaaggctatctacgacctgagatctgctggctcaactgggacatgaccaaagccctcctggccttcgtgatcccagctttggccatcgtggtagtaaacctgatcacagtcacactggtgattgtcaagacccagcgagctgccattggcaattccatgttccaggaagtgagagccattgtgagaatcagcaagaacatcgccatcctcacaccacttctgggactgacctggggatttggagtagccactgtcatcgatgacagatccctggccttccacattatcttctccctgctcaatgcattccaggtaagtccagatgcttctgaccaagtgcaaagtgagagaattcatgaagatgttctgtgattaggtgcttgtgacattagatttctacataaaagccaatggatttggaatagcatatggagtggggaaataaacttttgttccagagatacctggatttggatcctgactctttcatttactaataatgtataacatgatcttgggatatttactcaacttttttcaagccatattttcctcacatataaaatgagtgcaatactgttcactttataggggtgtttggaaagtgaaattaaatggtgaatgggaaaggatcaagtactaaaatgatctaaagaccatagacagcctagtaataggctaagttgttatggtttaaaaattaagcaataacaccttccccaaaatttaggtatgtagctggaggtattaaagtttgcacatttattacatttccttccacttaggatttttaactaccattggaaaccatcttattttaacatggcaagctctacagagaggtattgaagatagtttctcctctcttctcttatcacacttagatgaattaagcaacgttcacagtttcatgtgtatgctttgccaaattttctatgcttatacaaacatattttcacataacacgggttaaaacaatgtatattattgtgtaacttgcttttgcacttaaaaatatgctctagaattttaccagctcattatgcatgaatatttctctaatggctgcataccattccatattcaataatttccttcttgattgaaatttttctccattgttttgtgttatagtatgtgaatgatccaaagtttattatattgaatgttaatatgtagatagtaactaattgaaaagaaagcttttatttttctaaagatatctaaaacactgtctttttttctgaatgtgtgcggtagccagtaggactattttcaagtaaatgctttacctaattgctaatagatatcttaagtcaagtatcttctcattttcccttttcagaatttatgtataaatgatttcactttataataaatgctttgatgtcttgaagagcaatgttaataataataggggtatctcatattttgagtctctactttttttgcacttctatagaaaatattaattgtattctacatttgtatagcttttggtacttatcagttgctttacgcatgtttacaaaactagtcattgaaaagacttgggtaaaacccctatttttcataaacccctcatgagctcatgactcattccacaccattttccttctcttgtctcccttagggccatcttatctgtgagctttgttttggacaaggctgtgagcacttgcattttgatatcatgagcacctttatctgtcataataggatcacttgtgctttcaatttagtttctgccttgaatcccagtaaggaacagggaggggtctatctaagcgccagtacagatggggcagtgaggagctgagaacaaagtgtcagtgaggcccagtggggggcactgggcagtgctgtgttggagctggcctgtattggctcacgggagctgccaattatattttcacaattgttctgagctggttgtgaagacagtcatcaataacaattaaatcatatagacttgcaattaaacaaattaggttaaaagtaaaggtcatgtatcctcagaactcatcacttcctaattatttgtctaccttttctcttgaggttacttgcctctattgtgtctgcatggtggaaaatctgtacaacgatgtgctactgcccatctcttcctaaatccatgctcagcgatgtcacagggcaagattcaaataggccatggtgggtgtaattaactatagagattggcaaacactacaaatgaggagagtttattgccatttactagcatatcactggatcagagcatccactgagggaggagagagaggagccatggatctactgagatgggagactcaaccaactgggtggaaaaagcaggagaagtgcagtcttaggatgagaagagatgaggggcagcagcagaggctgatggagcagacagaggggagcgattctgaaacatattgagaagcccagatgatgtgggaggaagactcctgtaaagatttcctggtcctagccccaggggaatatctgcactagttttaaagctcaaccatcccctttactatagaggttttattatggtgtcagttgctgcctcgattaaccgccttgttcatccataacttctggttggcatcctactcttgtatttactgagaataattgtgggctgggtgagtttttgggactccctcatagctgtttttgtgggaaaaaaaataaagcacatataccaaaacctgggagaacaccttgagatttacctgtccaaactgtgctttacctactaaaagaagtgcaaagaagctgctactggtgaattgtttgttaggtatattctctcttcccttctcaaccagatactaaactttatggccaatttttttatccaaatcttctgaaagatatttgacataactttctctaaggtggcatggaccgacaaaaagtgatcctagtggagtatttccctgttacatgtttataaagtcatgtttatagtcatgctacataactataaaagtgcaggttgcataataaagaaattaaacacatacatacactcaaatgaagagacactacatttattacttattttgtgcaaagcattatgcttaatgttgcagatacaaatatagatagaccaaccccaaggaattaaaaatcttataaggagagaaattcctcttagttctttagccaaagaatattagccatcagcatatttgtggaaaaaacatgctagaattgttgttcccagatctttaaaaaatataattcctgggccaaattcacagagatcctgacttgaaatgtattcctagtaccaaaatcaggctggaatatatttgtcccaaggggccttataagaatgataactttgcaacctaatagaccatgccaacaataattttttttgtagcagatacaataacagatttcaataattaccttgtaggctcagaatgttacacagaacaatctcataaaagccatatggagattaagcttttgagagttggactggctgaagagaaaggtgtatgttagtgtgtttggggggctggattagctgcaaggatgtacactggtccctgtaaggtcctccacctctcatctgggcttttaccaaatagcggtaggtttggtattgttctcagcgatgaataccaggttgtaacatctttatggtgccagctgtatacaacccatgcacctcaacaggcctctgggtaggtaagagttcacactcacttatgaagtcagagcagcttagcaaggctattcctaaataaaaggtcatgatctcacctcccttttcagatgcaccatggacggagtaactgcaaatttaggagaaatttttgtctaatgaatgttcctgtctatcacattttgaatgccaaaaaggaaattccttttccttaactgaaaaatggaactacaacttgcccttccttcgtcaaggggggttttgtgccagtgtatgtgaaaaagaagtaaaaacttcaaatggactatagctgtagaggaacagcctgttttgggttttatatggggtttttttggtatggaaaataaaagatataaaagctaattaattccttctatatcatcatattgggaatatttgtcatgtgcttagaaactcaacctatttaatgtcattaattttttgagaatgtaaacacttgacttttctctagaagttttataatattctttgtagtggatgagagaaggaggctgaaggtgttatgggaagctgagcaacagctgtttctgctgttttctgtggaagcttctcttacttattgttcagggacagcaagcctgcagttcattgcccaacacctcttctgactctttcttggatcattatattcagttgagaggcccacctcctgctaagtgcaaacacttttaatttgtccaacgtaaaaggaaatttaaaaaatattcctgtatgatgtagggaccttggtctctttggtttactgaggtacctctacagtggctgccatatggaagacactcatcaatattcattgaatgaatctaggtgttgtgagctaaggatgacaaattaagagatttcataaaattgttttcattttattgaaataggaattggtaataactaagagtatgttttaacatcatgattcttttgtaaatggctcttcttccctcttctgtgtttcccagggtttcttcatcctagtgtttggaaccatcctggatccaaaggtactgaatgtaaattcttcttgttgctttttctgtattatcagtacctggccatgtaaagacttgtaaaggctatttattgaaaagctttcacttcagtcatttgtacagatgtatgaagtctggatcactgctgtttacaatgcaaatgatattgaccagtttgcaagctcttatgggaataaatgttttatgtacattagggctgattcttaaaacaattgtaggtattactattttcaattttacagatgaggaaactgagactcagagtgaacagcttgctcaagatcactacagaaacccactctgattagttgaagcagaaaaggaacttattaaatctcacaatattatctttgggagggtctctttgacttggagttttggaggctgtactccaggaatacttaccaatgcacagcacagaaatgctccacaagagataccattgctcttccccactttgctgggcacagatagcacagctcgccaggccaatgtcgggcagtaaacacttaagccagagctgctgctactgctgcctgggagatcacctcaacctgcctgactggtacaccagcatctgcatttatgcactgtcatgtctgattggctgagttcaggtcatggagtcatatcttagctgcaaggttgggtggaagtgtgagttcctacttctatcttgaatagcagtggagtcaagaaaagaaactcttcaaatacagatgagtcttgataagtgataagcattgaagacaaaaaccaagcaaatgaacaaaccctcaaatgtttattcaggcttctaagatcaccctctttccattgtaccgtactaccttctggaaaaagaaaagcaaacaatcctctcagatataaaagcaaaagcaaaccccttctgtcaattaaagtaaataaataaataaaaatgaaaaggaacactaccaggttggatttacaaaacaaagcaaaaaaccaaacaaaaaaccccaaacaaacaaaaacataatccactccctcccccaaacaccccaccttcactgcagagtttgtttgtttatttatttatttatgttttactatttattttttatttatttatttattttttactaaataagaagagcacctgtattcagctggcaagacttagagaaaaggacatgttaattttttttttttttgagacaaggtttcactctgttgctctggctggagtgcagtggcatcatcacggctcactgcagccttgacctcttgggctcaggtgatcctcccgccacagcctcctgagtagctggaactacagacacatgccaccacacccagctaatttttaaacgtttttgtagagatggggtctccctacgttgcccaggttggtctcgaactcctgagctcaagggatacacccatcttggcctcccaaagtgctgggattacaggaatgagctactgtgtccagcctactgccagtaatattctattatattaatatcaaaggtttgttaaaaggtcaggagatggagaccatcctggccaatgtggcgaaaccccgtctctactaaaaaatacaaaaacgtaactgggcgtggtggcatgagcgtgtagtcccagctactcaggagactgaggcagggaaattgcttgaacccgggaggcagaggttgcagtgagccaagattgcaccactgcactccagcctggcaacagagccagttgggatgtagagatagtaatgctttctctgccttctccattagattatgacaaagaacaaatgcaattttgtaggtaaaaacgcaaagcacttaaggtatcgcccaatcatatgccacaggattatgtttctattatttataataacacaactagtatctgtagccacagtaccagcagccacatttttacttagtttaccagtgttaggtgagatgtgcaaagaactccaagtcatggaaccttctatcaagatgaaaacctcttacctttgcaattgtgatatgaaaggtaaatactccaaagtgtcacaggaccatacatgattcattgaccaaaagttgtatataccagtagtcttcaaacttttaggattagtaaaacacagtgagtacatatccccagatgtgttcattattaacctaaaaagtgttacatacattatgaaacctaagagtaaaaaagggtgagaacaaagaaatgtaagtagaagtgccaatgtatcttcacggatcccaatgggcccttgagcacaccgtcctccaaccctgaggggtggtttgaggtctgtgtgtgacaaagaatacggcatctgcagggaagggggaagccaccctgagctggaggactttggcatatatgaattgtgaacacagaacttctataaggccttggaaggtgaataatattttgtatagcagaaataagaagagggcctgtattcagcaggcaagacttagagaaaaggacaggatgacctagttagggaagaagaatttcatggactgttgctatgttgtatagtacttttttctttgagacggggtgtcattctgtcgccaaggctggagtgcactggcgtgatctcagctcactgcaacttctgcctcctgggttcaagcgattctcctgcctcagcctctcgagtagctggggttacaggtgcccaacaccacgcccggctaatttttgtatttttagtagagagggggtttcactatgtttaccagcctgttcccgaactcctgacctcaagtgatccactcgccttggcctcccaaagtgctgggattacatacaggcatgagccaccatgtccagttgtatagtactttttttcctctagaaaaggtgatttgaataattgacaaattgtgagaagtgattacggaagtgctccataaaaataatgccaaagctagggcaggtgcggtggctcatgcctgtaatcccagcactttaggaggccgaggcaggcagatcatgaggtcaggagattaagaccatcttggctaacatggtgaaaccctgtctctactaaaaatacaaaaatattagccaagcatggtggcacacgcctgtaatcccagctactcgggaggctaaggcaggagaattgcttgaacccgggaggcggaggttgcagtgagccgagatggccccactgcactgcagcctggataacagagtgagactgaatctcaagaaaaaaaaaatagaagctatgtcgaggaattctcaaacttgtggcaaactgcatttctcaggcattgggtccatatttaaggccctgaaagtgagtatcctatgccatctccacctctcttttctcttcccatctttccaccttttccaagactactccaccagaggtcactgatgccaccatatccctccaacagaacctagctgctaacacagtacctggccacaatatctgccaggcccaagcatacgtgttatcttcttatgatcttctaattcttaacttcttttgttaaatatccagataagagaagccttaaagggttgagtagcctctgcaaaaaggagctccagaatatcagaggtaaagctttcatattcatttttgtatttaaaagtttaacaagataacaatcttggagtttctggcatatggagtgttgctaacactctcaccttaacactttgcagtgtggatttcccagaagtgatgggtgcctcttaaacagttgagattctttctggaatatggggatgcaaagagatgcaagtggagttacatgaatttagaggagagtgacaaggtggctggcgttggagggtgaatctcaaaccacatagtaggagagcaggtgatgaaagaaatgagagaagtcttaggttcccatgacatctcacttgttctctatgactccaatcagttggcccacatccaaagtgtaaaaactccagggaaacaaattctgatcctacacaaagaactgctcaagaggggccagctgccatggtactgaagtggcttaagtgggcttggggcctgcacagggttgctgtagagaagattcagtcattggacagcaggctggactataacagggtcgttaacttatcttctattcctgtgacttagaaacattgttttgttatgcaaagaatgagggccatgaactgttttgagggagggaaaaactgccgctcaattttttaaaaaacttttaaatggcagcaaaaggagattcagggttggcccaaggaatacacccaaaacaagcaaggaggtgatctagagcctcccatgccagtgtctgctagggtccacatctcctgtcatggactggggcttcaggggatctgcatggagagaggctaattgatggggctgggcaccctgtggccctgagagcagtgttgccccatcctcgttctttgccttcccattctctctctgttgatttcttcagccctcctcttctcttctctttcttccctctcttttcctgttcccttttgccttactcttacctaacctttggtcttgtttttagtctttggtctccatacttgggagtctgctggtttctctgtacccttttcagctttaaaaaaaaaaagacccaaagtttaatgcaaatgacattaataaatgtctaaagcaatggttctcaacttgggctacacattaaaataaactgggaagcttcaaaaaatggggttgcctcggtcacacccctggagattctcatttgattggtctggagtgtggcttggatttgggggttttgaaagctccccgggtgattctaatgtacattcaaggttgagggtcattcatctaaagactccctgaagtgttctggcattgaaaatatttgtctccaacaagcatccctgatgtaagtactctcctctttcactttggtctgccgtggtgctctcaggagagagtcctgactctctcaatcccttccaatttagctttgctcctttccttacgtgtttcagaattgatccattcaggtcatcatagagaaattctgcttttcagtgtcataaaatcctagtcatttcttccacttctctttgtggttttatgtgactgataagtcaaaataatatccagcattttatgagtagttgtcgattgtctgattcagtggtgttgttggctgtaccttagaaacacctaagaagctttaaaaatataccacttcagggcatggtggctcacgcctataatcccagcactttgggaggctgaggtgtgcagattgcctgaggtcaggagtttgagaccatcctggctaacatggtgaaaccccatctctactaaaaatacaaaaattagccaggtgtggtggtacatgcctgtagtcccagctactcgggaggctgaggcaggagaatcacttgaacttgggaggtggaggagttgcagtgagcccgagatcgcaccactgcactccagcctgggtgacagagggagattccgtctaaaaaaacacacacacacactttccaggccgtactcaagaaaaattaaattagaaactcttggaggtagggcctaagcattctttaaagctccacagtgattctaacgtgctatctgggttaacaatcactggcctaggtactaggtaaatttatcctaatttcttgcacttctcccttcatttcttgctcactaactttaggtcactgcctgcaattagttttatcaaccctgctcagaggacagaagtaggtgtttcatctgtgctcttctcttctgctttgtaggcctctaatccctaggtagcaatcttctgtagtccagattcaactcccctcctcatggcacctgcttgggtagtatcagtcctgcttcccaaacccagcataataaatttgcttgtctgtgttcattttatatctgaagtgatgaattagcctatgtttatgtggtagtaattctaccagtgagttaatgtattacctatcttaggcaacacatttctaaaaaacgaggacatcctctggacacaggtgcattacaagggcttggctttaacgctgaggatttcagcagaccagctgagaaagagttatttgagatcttggagccattttgctgtctctctctctccatgccactcaatgtcttctccactgtccaacaccctcccaaattagggtctccttcagtaggcagagccaggccaggccaaggaggaggaggatctctcacagcagtcagttcctatgttgtcagcagttccaatataaaaaaggagagaagggagccgggcacagtggctcatgcctgtaatcccagcactttgggaggccgaggtgggcagatcacgaggctgggtgtggtggtggatgcctgtagtctcagctagtcgggaggctgaggcaggagaaacgcttgaacctgggaggcagaggttgcagtgatccgagattgcgccactgcactccagcctagacgacagagtgagactctgtctcaaggaaaaaaaaaacaacagaaggagaggagaggaataaagtgaaggaataaaagaaattgctgtggatcacaattccctagatgctttgaataattgtgataattgaaaacagactaataatgatatttaataaatgcaattttactttgtcttcaacagaatgcttcttctgaattatcttgtcatcccatcaaaggcccaagttaacaaaccaggctacatccctaacctaggaggtgagtgcaaagcaaggggttcccatatatgtcatatatgtgacatttcttttaaaattgcaatttgattaattataattagaaatgattttttcttcattaaaaggattctactatacagtctattctcacctagctatggttggaaatatattcacacttcaaattcttaagctactgaaattttttttgtccctgaaaattaagcaggcgtgtctgaaaatgcttttaaattagcctgggtgatttttagatgggagtgaggagagctgcctgctttacttagctgctccctctcttcaatcttctctctagttctctatcccaggacatcctatatgatatcagcagtatccccagatttcccattgtggcccctttcttttccctagcctgaaaagatcaaggtattatgataaataatagctgtgagaggcctcagggatgatggagacgtttatttacatttgagatctcagagatagacaaagatatatagaaaaatagaagtggagaaaggagccacagggagaaacagaaattcagatacacaaagacagagggacatggtggctcacgactagaagagagccacctagacacaaggacatgtgcagacacaagtcttccaatcctgtgtctcgatgtccctctggatctagagacagaaaagagaggaagacagaggaacccacatcgagatacccacattcatagggagacagagacagagagatgcacggagaggataagagatgcattgggagatcgagagaaatgcagaaaaaaaaaaaacccagagagatggactcacagagacacatacagcatgacagagacagaaacagagatagatgcactcagctatgtagagagggcctcccacccctcatcccaacacatccaggctccagcagcctttgtggctttctgtagcagtccagggccttgtataaaaagtgggtcttttccaagaagtgttacactgaaaaggaggtggcccagcttagagaaagacaaggtgtgtaattcagcatttgttggcaacagaaaagactgttctctggattccaaagtggcttaaagggaggagactctccatcggccataagggatgtacccaaatgggctcattgttcaagacagtgagcttataatgcagatgttgtaaagcctatgaatcttgctacctgtacattaaagctgtgatcttctgttcttgacagggttgtatatttcaggaatggcagagcccaaaggagaaatgtgctcattcctgtcttcttgcttctggagaatatgtaggaagctcacacatgtggtgctgatggaggagggcgtgatgtgcagaaaggatgaaaggctcctctgtctaagctgttctgtgctactaaacatttctcgtccatcaactgtacatagctacatatgtcatgctgggcagccacagcaaacaaaaagacaaagggggccacaaccgtggtttttgttggggcttccatctctatgctgttgggtcacatttgtcttcagaaagcaacctctgtctcatcttggaaaaggcggcctgagatttcacctggctggattctgtgtgttgctgagggaggagcctcatgaatagtcacaaagagttgggctgactctaagtaggacattgcagattatttttttttttcaaaaggaatccactgccagtatatccactttttcaaatttaaatagattggattgtcaacttggtttaggcttagatacaacttccttggccatgaaccaaggggaaaagcatagagcttttgagacagaaagatgaccattttcagttaaggagatggaagtctggagttgtgagtcaatgctaatcgaggactgagccagaggtagaaacccaagtgtgctggctcccagccctgtacttcctcttcaagaccatatagacactgaaagatcttctgcctacactgacaatgtaaggtcaatcctcaccaacaatatgcttttttgatacctgggattggagagaggaaatatcacatttccaattcagagctgctctttttcttaacctgtatgtaaacaaattcaacattcaaaccaggtgttacctgatagaacagtattgtaggtagaagctctttgaggaaaaaaaaaaaacctctttacaaagcaaggacatagatgactgcagcagcatctaactagtggatgaaggcaaaggggcaatgggcagcctttaattatcccaacaagaagtcagtattgatgacgtttcattacaaaggagaaagtggggctcaccttaggtatgagtgcagtcccttccttccttccttccttccttccttccttccttccttccttccttccttccttccttccttccttccttccttcttccctccctccctccctctctctctctctttctccctttctctttctttctttttttctccctctctctctttctttctttctttgtttcttattacaaataatcttcctataagtaggaaagtttgagcagacaaaaagcatcaatctgaagttaaaaaaaatgcatcaacctggagaaatagtcatttttcaaatggcattgcttatcttgggacaacaaaagcatccttcacaaataaagtcagagagtggttttaatttaccatttaccaatagatttgtatgttcttttcaagagaaggggtgagatagacatagtcctggttttcctcaatgcaggcttaggtacaaagagatgtcacttacccagagtccatatattgaagtgaaaatggaatttcatgaagcaaatatagttataggatggtaactctggacaaattttataaaagatgaactccaattgcttcatttcacagataacagctctgagcactagggagagagggagggattggcctagcatttgctttgtgtcttgagcagtcacatctattatggaagtactcactactcagctatactcactccctgagacaggatggttggaaagaaaccccaccttagcttcatcattaaccaagaaaccccaaggatgcttagagaaaaactctggaattatttgggaattcctggaagaagctatgccctctctcctgcatcccaaagcccactctacaccatcttgaaaaatgtcaaggaactgcatggattaggttgactctggatgaccctgggtagagacacattcagtttcctgctgacaccgcaccaagaaagtgatttggtcaggtgactctaggagaaattggtactgatagtatccaaggcagatttttaagtatcagacttaatacataatgattcttgggaaagccatttaaatccctgagactttaagtggataaatgtaggtaaagtagtatagtacttggctcataataattgctcattcaaattcacatgttagttttagttgttttttttaaattagagtcctgtgaatacatgaacccacccacccacatgcaaacacaagcaaacacacagccatgaccccatgcataagtttggctgaagacaccctcatgggaactagttcactgacttccaaattaaagagttaagcatttgatttggtctgttcaacattaggggtatcagccagcaaaatctgttgagcttaccattgaaaaatcctttcattcattactgtggtcataatacacagttacctggccaggaaagagtacacatcacagggatctgctcactgcacgtgtgcctgagctctccctcactttctgccttcttcaagaattcttccctgattggtccaaccagaagcgctgattctccccacctgatttcctgtaattttataatctatgtccttcacttttgtgttatattgtttatttccttttggtctttttgtgtgcatatgtatatgttttggggaatggggtattcacttttgttactcactgtgttactcacttttgtatgcccatagtgcagagcatggtgccttgtacatagagtatgttcggtaaatatgtgcaataaaaagtcctttgattacacaa

SEQ ID NO: 150 - DNA, 23 bp, Artificial Sequence
  A synthetic oligonucleotide
tttttggttaaaccctacatcac

SEQ ID NO: 151 - DNA, 23 bp, Artificial Sequence
  A synthetic oligonucleotide
tccctagcccatttctaaatctt

SEQ ID NO: 152 - DNA, 20 bp, Artificial Sequence
  A synthetic oligonucleotide
tcccttgccagtggaactat

SEQ ID NO: 153 - DNA, 20 bp, Artificial Sequence
  A synthetic oligonucleotide
tcggccagaagagtctgttt

SEQ ID NO: 154 - DNA, 20 bp, Artificial Sequence
  A synthetic oligonucleotide
tgaatttctgggcatgtgaa

SEQ ID NO: 155 - DNA, 20 bp, Artificial Sequence
  A synthetic oligonucleotide
gagaggcctgagcacaaaag

SEQ ID NO: 156 - DNA, 1029 bp, Artificial Sequence
  A synthetic oligonucleotide
taatcgactcatgcggtgattgggaattctttcagggcaacaggcaatgtgttaaatatgcactgttgagtacactgtgcaaagttatgaaattctctctttccctcctgacatttttttttccaagtacttcactggctactccagaagcaaaggaatagagaaaagagtgaaatcagaactagtgagtggacttggttactgtaagatcactggtaaaagtctgaaagaaacaaaggtggagcaaattcaaaatggatcagatgtgtgtacacatgtatcaacaaatagaagttaagccataatgggcacaaggggacacttcagctccgggcaagagttaggctatggtagtgaccttggatcctaaagctgggctctgtccttgcttcacagtgagaatcagtaacacctcatctcattagctctcttatcttcaaaagtatccaagtcatacctgtaatttgcccctcatcctccaagagttgtacaaatttcaggttcagctgaaggactctgtggttcaggtgaaaaaaaaagccataaatacaaagcattattgtagggtgctttggactagaaccctgtctaatatctgggccttgatatttcagcctttcagacaaggccaaggagctcagagacaaggactccttcaatcagccagcagtgccactgaggtgccccggcgggctggacaggaaagcatggagaacatggctgcaatggaagccaaagcagcaggtcttccaaacacagactcagatgcctgtgtctttaagaccagaccctcataaatggattgcttctgctggacaccacgctctaaataaacagactcttctggccgacacacaacttcctgtaggattctgggggggtaaagcttgaaaaggctgccaaatccaatgaccagcaacttttgagctgacttagaaaacaagctacaaagacttgagtccagagtaaacaaaggaaaaagccatattaaacagggaacaaattactatatcggcagggaaattttaa

SEQ ID NO: 157 - DNA, 1029 bp, Artificial Sequence
  A synthetic oligonucleotide
taatcgactcatgcggtgattgggaattctttcagggcaacaggcaatgtgttaaatatgcactgttgagtacactgtgcaaagttatgaaattctctctttccctcctgacatttttttttccaagtacttcactggctactccagaagcaaaggaatagagaaaagagtgaaatcagaactagtgagtggacttggttactgtaagatcactggtaaaagtctgaaagaaacaaaggtggagcaaattcaaaatggatcagatgtgtgtacacatgtatcaacaaatagaagttaagccataatgggcacaaggggacacttcagctccgggcaagagttaggctatggtagtgaccttggatcctaaagctgggctctgtccttgcttcacagtgagaatcagtaacacctcatctcattagctctcttatcttcaaaagtatccaagtcatacctgtaatttgcccctcatcctccaagagttgtacaaatttcaggttcagctgaaggactctgtggttcaggtgaaaaaaaaagccataaatacaaagcattattgtagggtgctttggactagaaccctgtctaatatctgggccttgatatttcagcctttcagacaaggccaaggagctcagagacaaggactccttcaatcagccagcagtgccactgaggtgccccggcgggctggacaggaaagcatggagaacatggctgcaatggaagccaaagcagcaggtcttccaaacacagactcagatgcctgtgtctttaagaccagaccctcataaatggattgcttctgctggacaccacgctctaaataaacagactcttctggccgacacacaacttcctgtaggattctgggtgggtaaagcttgaaaaggctgccaaatccaatgaccagcaacttttgagctgacttagaaaacaagctacaaagacttgagtccagagtaaacaaaggaaaaagccatattaaacagggaacaaattactatatcggcagggatattttaa

SEQ ID NO: 158 - DNA, 1007 bp, Artificial Sequence
  A synthetic oligonucleotide
taatcgactcatgcggtgattgggaattctttcagggcaacaggcaatgtgttaaatatgcactgttgagtacactgtgcaaagttatgaaattctctctttccctcctgacatttttttttccaagtacttcactggctactccagaagcaaaggaatagagaaaagagtgaaatcagaactagtgagtggacttggttactgtaagatcactggtaaaagtctgaaagaaacaaaggtggagcaaattcaaaatggatcagatgtgtgtacacatgtatcaacaaatagaagttaagccataatgggcacaaggggacacttcagctccgggcaagagttaggctatggtagtgaccttggatcctaaagctgggctctgtccttgcttcacagtgagaatcagtaacacctcatctcattagctctcttatcttcaaaagtatccaagtcatacctgtaatttgcccctcatcctccaagagttgtacaaatttcaggttcagctgaaggactctgtggttcaggtgaaaaaaaaagccataaatacaaagcattattgtagggtgctttggactagaaccctgtctaatatctgggccttgatatttcagcctttcagacaaggccaaggagctcagagacaaggactccttcaatcagccagcagtgccactgaggtgccccggcgggctggacaggaaagcatggagaacatggctgcaatggaagccaaagcagcaggtcttccaaacacagactcagatgcctgtgtctttaagaccagaccctcataaatggattgcttctgctggacaccacgctctaaataaacagactcttctggccgacacacaacttcctgtaggattctgggggggtaaagcttgaaaaggctgccaaatccaatgaccagcaacttttgagctgacttagaaaacaagctacaaagacttgagtccagagtaaacaaaggaaaaagccatattaaacagggaacaaattac

SEQ ID NO: 159 - DNA, 1029 bp, Artificial Sequence; identical to SEQ ID NO: 156
  A synthetic oligonucleotide

SEQ ID NO: 160 - DNA, 1029 bp, Artificial Sequence; identical to SEQ ID NO: 157
  A synthetic oligonucleotide

SEQ ID NO: 161 - DNA, 1007 bp, Artificial Sequence; identical to SEQ ID NO: 158
  A synthetic oligonucleotide

SEQ ID NO: 162 - DNA, 20 bp, Artificial Sequence
  A synthetic oligonucleotide
ggaattctttcagggcaaca

SEQ ID NO: 163 - DNA, 20 bp, Artificial Sequence
  A synthetic oligonucleotide
gacagagcccagctttagga

SEQ ID NO: 164 - DNA, 20 bp, Artificial Sequence
  A synthetic oligonucleotide
ttgtgtggcctcactcaaac

SEQ ID NO: 165 - DNA, 20 bp, Artificial Sequence
  A synthetic oligonucleotide
cccttgacttgctgtgaggt
